United States Patent 10,724,096 (METHODS AND COMPOSITIONS FOR INHIBITING AND TREATING NEUROLOGICAL CONDITIONS) - sequence listing, part 74

SEQ ID NO: 1522 - DNA, 3491044 bp, Homo sapiens (residues 1-1,745,522 of 3,491,044)
gcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcagcacagcggccctgctaaataaggaacgcctggagccgcggttggcacggccccggggagccgaaaaaccccgggtctggagacagacgtcccacccgggggctgtgcagacgccagcgggggcggggcgcggaggccgcgctcagctgggaggacaaacagtcgctaattggagaggaattgggatgcggcctggggctgcggggtacccggagaggtggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggcttgctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggagcccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcatgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaatgatgctgccgagaggtggtggcttttggaaaagatggcgtactgcaaaacgtgctgctctgcgtggctcgaagcttcgtggggagacgtgggcagagccgtggctgactcacagaccccccaccccagagcctgccctgccctccctgccccgacccttcccctcctgacccatgtgttttttttttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaatactgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagcgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatactttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtgtatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtctcgatctcttgatctcatgatccacccaccttggcctcccaaagttctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttgtccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggcaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctccttcgcctgcctgtccctctgctccggccccctgccgcctcctgcccccacctgtaggagccccaccctcctccagcacgtcttccctgcctccccaggggccgccctggtggggccccacggacccctggcctccggccagctagcagccttccacatcgctgccccgctccctgtcactgccacatgctgggactttggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctgaagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgctctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagctgagcactgcgtccggctcgggcccaccgggtggtgtaacaccgacctgtgctcagcgccgcacagctacgtctgcgagctgcggcctggaggtgtgcggggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcagtacggcctctcagccccgcacgagcccctggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagggcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgggaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggcttgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcggtgccaccatgctgggtacatgggggacagggctgttccatcttgcgggtacctgccccttcaccaggggccttgggaggggccatgagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccacgtgggactctccagcccgacgggaggtgtgtccaggaggcgacaggctaagggcagagtcctccacagagcccaggctgacaccagtccccccgcagaggtacagccccgtggtggaggccggctcggacatggtcttctggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccatacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggcgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagtgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgtcagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgctctcaccaccaaggtgcacttcgaatgcatgggtgagtgcaggcctgcgtagggggagcagcgggatcccccgactctgtgaggtcacggagccctcccgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctctccccctcccctctcccctcccccttctctcccctctcccctctcccctcccccttctctcccctccccccttctctcccctcccctctcctctcccccttctctcccctcccctctcctctcccccttctctcctctcccctctcctctccccccttctctcccctcccctctcctctcccccttccctctcctctcccccttccctctcctctcccccttccctctcctctcccccttctctccccttccctctcctctccccttccctctcctctccccccttttctccactcccctctcctctctcccctctcccctcctcctcctctcatgtgaagaggtgccttgtgtggtcggtgggctgcatcacgtggtccccaagtggaggccgtgggtcatgcagagccacagaaaatgcttagtgaggagactgggggggtccagtcaagtgggctctccagctgcagggctggaggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatccgccttatccccttcccctcccttccccctgctcctcttcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcctcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggacttcgacatccaacctggcggagcctgggctcacgtccactgccccttcccttcccaggaccagagacccagtggggagttaccgtctgaacctctccagtcacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggaatgagtctcgtcgcaggcgtcagaacaaggcagtttttgcagtactgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcaggcggaggtgccagcaccctccccgtggctgtttcttcaatacctccattttcctttattggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggcgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggcgtggacaggtgtgcagtgcgggtcactggttgtggtgtggactgaggcgtgtgcagccatgtttgcatgtcacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcccggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctatttcactcacatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgatggccgggtgtggtggctcacacctgtactcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactcctgcctgggtgacagagcgagactccatctaaaaaaaaaaaaaatgaaatttaaaactctgttccttagctgcaccagtctgctgtcaagtgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtgccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttagccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgagctttgtttcttgaaatgcacagattccttggacatccctgagaggccagtcatgaaagtcagcttggttttctccccctcatttgggttcagaatttaaagtccacacacacgggcagtaagataatatagataaggacatcatcactcggtttcggatgttaaaatgtctaggtgggttaggggtgatttgagatcacgcaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatccggcccggtccccgtccccttccctcccccctgccctaagccacctccacctctgtcctggccacctccgggtgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttttacttatgctgagctttaaatgacaaagattcatataatccaagagagaagtattatttagagggattcttttaccatgtgatatataataaatgcatccaatgttatacatcaatttaaaaaacaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagagtcacttgaacctgagaggcagaggttgcagtgagccgagagcacaccactgcactccagcctgggtgacagagtgagaccccatctcaaaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagagggtcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatccgtatgtcaaaagtctgtacttggtaagaatttggctgctaagttgtggcataatttgtcttttgagccttttttcctttgggtaagttgagctctacattttgtcttgccattcatgacagtaaaaatgtggttgtgtgggggctgaacctccttctgaacaatgatccaagataaaagtactaataccacaatgctttttgatattcaagggaagaggaagtatgtttcagttttaccgcctagataattacacgtcatttggcactgcctttcaagatatgtggaaaacagaaaatatatgagttatgaagatatctaggcacatttaacattctctatgccacttagtcctgaacagagaatttttggtataaattggaggaagctttttttttttttttttcttttctcacccccaaaaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttttatcctatgtgcagaaatcaggaaaaaacaaattctacaaagaatttgaaagatattatttcaggccaggtgtggtggctcatgcctgtaatcccagcactttgggaggctgaggcaggtggatcacttgaggtcaggagttcaagaccagatgggccaacatagtgaaatcccatctctactaaaaagacaaaaattagccaggcatggtagcaggcacctgtaatcccagctacttgggaggccgaggcacaagaatcgcttgaatctgggaggtggaggttgccgtgagccaaggtagcgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcattaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctccggagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatttttttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccatgccagcctcatgtcattcttgtgtggtgtgtgtgtgtgtgtgtgtgtgtgtgtgtgtgtgtgtgtgagacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggcgtgagccaccacacccaggctttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaactcaatgcttgggtcacctccagattcattttcacagtctttcatgttttggtcatactacattgtattttgctgccatatgactgatctttttttgttaaatgtgagatacttgttaaaaaatatttaacaatgaattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatctgagatcagaagcttcagatgcacttatgtcaactcaagagtagaatgcttccttagcctccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcacccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggagaagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcaggcagtaagcaagaggaggaatcaatatagcaacagtttggatcagactgtacagtttttttgtttttgtttttgtttttgtttttctgagatggagtcttgctgtgtcacccaggctggagtgcaatgacgtgatcttggctcactgcaacctctgcctcccaggttcaagtgattcccctgcctcagcctcccgagtagctgggattacaggcgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattgcacgcgatgggacttgtacacttgaaatgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgtttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaaactctctcctggccctcctctcttgccagcactatgggtgactgaagacccccagggaggcacagcatcctcttatctaagatttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcctggctggttttttaatttgtatttcctttgagacagcgtatctctctgttgctcaggctggagtgcaatggctcaatcagctcactttagccttgaactcccgggctcaagtgatactgccacctcaacctcccaagtctgctactacaggaacacaaactccttttttaaattttttgtggatatggggtctcactatgttgcctaggctggtctcgaactcccaggctcaagcagtcctcctacctcagcctccacaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtctcgagctcctgtgacacatgactcctctctcttcctagtgatccaagccctgccacttcctgactttgcccacactgtaccctctgcctggggcaacttcatgtctgcccattgacccttaggcctcagcccaggcacaagcccctgcctccggaggtcatccaggcctcaccaggctacaccctctcgtaaaattggattccctcccttcagggcagctttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagctcaccaggccaggcccagtggctcatgcctgtaatcccaacactttgagaggccgaggcaggtggatcacgaggtcaggagttcaagagcagcctgaccaacatggcgaaaccctgtctctactaaggagaatcgcttgaacccaggaggtggaggttgcggtgagccaagatcacgccattgcagtccagcctgagcaacagagcaagactctgtctcgagacaataaaaacacataaaaaattaactcgccatgatggcacatgcctgtagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattcccctgcctcagcctcttgagtacctgggactacaggcatgtgccaccacgcctgggtaatttttgtatttttagtagagacagggtttagtagagaccatggtgaaaccccatctctattaaacaaatctctactgaagatttgctgtactgaagggatagcaaaactcagttaccaaaatggcaatgtgtttgaactgtttacaggccaagaattcacatttgcaacccacgcaatacactactgattgtgtgacttcctctagagagaatgtcaaaagttacaatgtgatggcttttatgaatgtgagatgaggcccagtgtgccttctcctcttcggtttgtgcctcaatgatcatcacctcccaaaacatatgctgagctcccagcttccaggcactgtcccaaaagtggggtgtcagtgggaacccaagcaacagacaatatagagtctcgcacctcatagaactcattttctccttgcttctttttctcaccttttttttttttttttttttttttgagatagggtcttaccctgtttcccaggctggagtgcagtggcacaatcatagctcactgcaacctcaaatgcctgggctcaacgtagcttcctgcctcagcctcctgagtagctgggactacaggcacccgccaccatgtccggctaatttttctttctttcttttttttttttgtatttttagtagagatggggtttcatcatgttagccaagatggtctcgatctcctgaccttgtgatccacacaccttggcctcccaaagtgctgggattacaggcatgatccaccgcacctggccctgattttaacttctcttttttctttttttttttttttttttttgagacagactcctgttgcccaggctctggagtacagtggtgcgatcttggctcactgcaacttctccctcccaagttcaagcgattctcctggctcagcctctccagtagctgggaataaaggcatgcgctaccatgcctggatcattttggtatttttagtacagacggggtttcgccatgtgggccaggctcgtctccaactcttgtcctcaggtgatccgccggcctcggcctcccaaagtgctgggattatagccatgagccaccgtgcctggccttgatttttagcttttaactttgaaataactacagactttgaaagaagttgcaaaaatagtacaaagagttaccacatactcttcatccaagcttcctgaaatattgatatcttacatgaccatagtacaatgatcaaaacaaggaaataagcacggaaatcatacacgtacctaatctacagatcttattcaaatgatcaccgatcgtcaccctaaggttctttgttcccagtctggcctccaatcccagattgcttcacattgtgttgaactgtcaaatggccttagtctccaagtgagatcactaaccggctattctgtaggctgtccctcagtttatcaacccagttgttatgggctaaatgatgccctccaaaattcatatattggagccctaatttccagtacctcagaaggcgactgtgtttgaagataaggcctttaaaatggcaattaagttaaagtgagacctttaggatgggctctaatccaatctgtctggtgtccttataagaagaggaaatttgggggcatggttggtggctcacacctgtaatcccagcactttaggaggctaaagtaggaggatcacttgaggtacgaagatcacttgagaccagcctggccaacatggtgaaaccccatctctactaaaaattagctgggtgtggtggcacatgtctgtaatcccaactacttgggaggctgaggcaggagaatcgcttgaacctgggagagggaggttgcagtgagaggagatcgagccactgcactacagcctgggtgacagagcaagattccgtctttaaaaataaaataaaataaaaaaaaaatttggacacacaaacaggcaccaggggccgggcatggtggctcatgcctgtaatcccagccctttaggaggccaaggcaggaggattgcctgagctcaggagttcaaaaccagcctgggcaacgtagtgagaccctgtcactctctctctctttttttttatttaaaaaataaataaataaaacgaggcaccagggatgttttcacaccaaggaaagaccatgtgaagacacagcaagaaggcagccgtgtgaaactaacccagcaggcaccctggtcttggacttcttgcctccagaagggtgagcaaataagtttctattgtctaagccacgctgtgtgcgctattttgttatggcagccccagcaaactaatatatccattctcttcagttcttggaaatctgcccatttctatgttctctgaccctttttatctgcccgtttattgatttatagccttctccggctccttatccttgttactggtccggagtaaacttctgttagatttctcccagctgggcaggcttccagctcaccaaaacatctccttctttgctttttacttatatcccccttgtatcatttttccatggctgaggtaacaaattaccacgaatttaatggcttaaaagaacacaaacttcttgtcttagaatttggggtgtcagagtctaaaatgggtctgcaggactgcattcctcctggaggtcctaaaggagagttcattttcttgcctcttccaagcttctagatgctccctgcactccttggctccccatccaacatcttcaaagtcagcagcataaatcttcccatctccctttctctctcttttttttagacaaagtcttactctgtcacctaggctggaacgcagtggtacagtcatagctcactgcagcctcaaaccccgaggctgaagtgatcctcccgcctcagcctcacgagtagctgggaccacaggcatgcaccaccatgcctggctgatttttaattttttatagagacaggctcttgctatgtcaccagggctgtcttgaatttgggagcccgcgatcagaagccagcatggtcggcagctccctacaccacgtccgggcttcccgggcctccagctgccccctgcgccgccgccgcctcccgcacctgcacgtggccactccagatgctccggagggattgagcaccccgcgcacacccagctcacaccatccaatccggaggccatgggccgacatgggggctgagcgtttgaaatgagcccggaccaccagatgcatgggtccgttcacacgaaatacccagaacaggcaaagccacagaggcagaaagtatggggttatttattttaattaattaattaattgttttgagacgtagtctcctctgtcgcccaggctagagtgccgatccctatgttagcttgatgtggtggctcatatctgtaatcacagcactttggtaagctgaggcgggaggatcgcttgtcaggccaagagttcaagaccagtctgggcaaaatagtgagacccccctgctatggtttggatttgggtccctgcccaaatctcatgccgaattataatccccagtgttaggggagggacctggtgggaggtgattggatcatggggggagagtgcctccttgctgttctcctgatagtgagtgagttcttatgagatctggttggtttaaaagcatgtagcgcttcccccttctctcccttcctcctgctccagctatgtaagatgtgcgtgcttcccctttgccttccgccatgattcaaagtttcctgaggcctcccagccatgcctcctgcacagcctgtggaactgtgagtcaattaaacctcttttctttataaattacccagtctcagggagttctttatagcaatgcaagaacggactgatacaacctccatatctacaaaaaaaaaaaaaaattgttttaattacctgagcatggtggtgcacacctgtagtcccagctactctggaggccaaggcaggaggatcactccagcctgggcaacaagagcgaaattccgtctcagaaaaaaaaaaaaaaattaaaaaatttaaaaaacgtaaagaaaaaaattattttgctaaatctggcaaagccaaagggatgaaactgacatttactgggcaccttctgcacaagtcagttctcctaggaacccagagaggcaagggattggtagcaatctctagaggcaaatatcctctaatatccatggtgttctttgtggagcagctcaatggatttacttaatgggaaatgaaagaaggaaaaatgaagacttagaaggcttcgatgatttccaatgcattactgtatacttatctcttcttagaagcaatagaaaaaaaaatcaggaattaaagacaatctattactcaagcaaatgctaaaggcctcccatggtcttcaaacaagaagagatgctctaagataaattacttcattacgttgatgcttcatcatccgtggaagctgtgactcagagccctgcagcaataattaggcagtgcgttcatgtcccgttaatgtccccaaacagtgggagatgaatggagaacatagggctgtgttcgaatgaaaaaagggttttgttcggcgctctttcagcagggaataagtactgatgtgggaactgagcttctgtttacaactaaggatcacattaaaaatatattaagatgactacagtaaagcttattgtagctattattatttcatttaaatgaatcccagtttcataagaaccaccaagggggctaccatgtctaaaatgtaacttctctgcgaatcctgaaatttctactgacaaaagactacgatgcacaattaattaattaattaattaattaatttgagatggagtcccactctgtcacccaggctggagtgcagtggcacgatctcagcttgctgcaacctttgcctcccgggttcaagcgattctcttgcctcagcctcctgagtagctgggattacaggcatgcgccaccacgcctggctaaattttttcgtatttttagtagagatggggtttcgccatgttggccaggctggtctagaactcctaacctcaggagatctgcctgcctcggcctctcaaagtgctgggattacaggcgtgagccaccatgcccggccaacacgcaacatgtttaagaccaaaaggactgttttgcaatgaagcagatgaatcaaccagtaaggccaacccctcaaaaaatgtagcactgaagtttcttcaacatctgcctctgagacttgttcatatgtgcagacacagagcaggaaactaaagcaactgccttcctctttgtcacctgaaatgagaatggagagaggctggcaaggaaatgatatgtaatcttccctccttcctgattttcttttctatccttttttttttgagttggagtctcgctctgtcacccaggctggagtgcagtggcacaatcccagcactttgggaggctgacgggggtagattacttgaggccaggagtttgataccagcctggccaacatggtgaaaccccatctctactaaaaatacaaaaaattagccaggcgtggtggcatgtgcctgtaatcccagctacttgggaggctgagcatgagaactgcttgagcccgggaggtggagattgcggtgatctgagatcgtgtcactgcattccagcctgggcgacagagtgagactacatctcaaaaaaagagaaaaaaaagaaaagaaacatttacaatctattcactctgaaatttacagtctatttactctgaagcctgctacctgaatgcttcatctatgagataaaactttagtctctgcaacctcttattgtaacccatatatccctttctattaataataactctttcaaccaattgcccatcagaaatctttttttcttttttttctttttttttgtttttttttgttttttgagacggaacctcgctctgtcgcccaggctggagtgcagtggtgcgatcttggctcactgcatgctctgcctcctgggttcacgccactctcctgcctcaggctcctgagtagctgggactacaggcgcccgccaccacacaccactaatattttgtatctttagtagagatgaggtttcaccgtgttagccaggatggtctcgatctcctgaccttgtgatccgcctgcctcggcctcccaaagtgctgggattaccggcatgagccaccgcgcccagcccagaaaatttttaatctatctataacccagaccaaaccaatgtaaatctttaaatgtatttgactaatgtttcatgcttccctaaaatgtataaaatcaagctgcgcccggaccaccttggggatgtgctctcttgctgctacgctttctgcaaattttccatacaatttttctttttcttttttttttttcacacagagtctcactccattgcccaggctggagtggagtggcacgatcttggctcactgcgacctctgcttcccaggctcaagtgattctcccacctccgcctccaaagtagctgggactacacgcccagctaatttttgtgttttttgtagacagggtttcgccatgttgcccagactagtcttaaactcctggactcaagcaatctgccctcctcagcctcccaaagtgctgggattacaggcaggagccactgcacccagctagaagagggaaagtttaatatagttgattctcattattcaagatagttacattcaaaaaagtcaccaaggacactgaattggtgaatattgaatcatttgctctaaaggaaatgcaggattgggtgtctccaagcctctggtcgcaacatttttataaagcaatcaatacataatcttcttttatgtgtgtgtgttaaaggacgccttatctaatacatattgttgattcattgacattgaactcacggccaacagcattgtaactcatgcctgaacaaagcttatctaacaaatgtaccttctccattaggtacttcacagccttcttgcactcagagacactggatagcacttcaggaggacacttaggggccttctgttgttgttgatgttgagatgaagtctcgctctattccccagtctggagtgcagtggcgtgatctcggctcactacaacctccacctccaagattcaatcgattctcctgcctcagcctctggagtagctgggattccaggtatgcgccaccatgcccggctaatttttttaatttttagtagagacagggtttcactatgttggccaggctggtctccaactcctgacctcaggtgatccaccagccgtggctttccaaagtgctgggattacaggtgagagccaccgcacctggctgggggccattttaagcagcaaaatcacaaaaagcacagaactgtgaaagatgtgacactgaatacactgcagagaggacacttgtttgcagtctgaaagctgagacaagaaggcagagtgtggccaggtgcagtggctcatgcttgtgaccctagcattttgggagactgaggcaggacgatcacttgaggtcaggagttcaagaccagcctggccaacatggtgaagccctgtctctactaaaaatacagaaattggccgggcgtggtggctcacgcgtgtaatcccagcactttgggagaccaaggcgggtggatcaagaggtcaagagatcgagaccatcctggccgacatggtgaaaccccatctctactaaaaatacaaaaattagccaggcatggtggcacccgcctgtagtcccagctactcaggaggctgaggcaggagaatcgcttgaacctggaaggcagaggttgcactgagctgagattgcgccactgcactccagtctgaagacagagcaagactctgtctcaataaataaataaataaaaataaaaatacagaaattagccgggcatggtggcacgtgtgtggccccagctactcgttgaggcaggagaattgcttgaacctcagaggtggaggctgcagtgaaccaagatcatgccactgcactccagtctgggcgacagagcaagactctgtcttaaaaaaaaaaaaaaaaaaaaaaaaaaaaaaagaaggcagagtgtcaccttgttggacctcagctgggaatgggtgcatcatgtgacttaaatattttgctgctctctgcatgtacatgtcttcagataatagcaaaagcaccagaggtattgatttggggtccaaatacattttagaaaggtagacacatttataaatatggaacccatgaataatgaggatggactgtatgaagaattgttaataggagactggaataatgagggtttgagtagtaagaagggaactctgaagagtatacaggcagatgcagggggctcatgtctgtaatcccagctctttgggaggctgaggcaggtgattagcttgagctcaggatttggagaccagcctgggtaatacagcaagactccatttctaaaaaaaaaaaaaattttttttttaattagctaggcatgggggctcatgtccgtagtcccagctactcgggaggctaaggtgggaggattgcttgagccagggaagcagaggttgcagtcagccgagattgtaccactgcactccagtctgggcaacagagtgagaccctgtctcaaaaaaaaaccaaaaagtatacaagtagtagatacaaggaacagctactacccctaggactgagatatgacacttacggaaacaatcacccctggagggctgagatcttgaccaggtagagagggtacagccctgggtcactgaatagcaaagaagacagttgacgtgatgccctgctggttggtggaacttgctggaaatctaccctcagggtaaacttttcatggcaaggtgtctcactgaaggtactctgctgcaagaccaccagaggggagtgccaggggaagctgcctgccaatgagtggtataggagctgggcactggagaagccatcagcaggaaccaataagcaaaaccctttcctcctgcagtgtctctccagcaccctgtactgacaaaacttaaaataacattgtgcctcctggcaaaggaaagctatttaaagggcccagatccatttttacccagaaggcaaaaaggatggatttggagctggaaggcaatagatcaaaaactgactgttttgatgttttttattttctttttttagagatgggatcttgctgtgttgcccaggctggcctcaaactcttgggttcaagtgatcctcccaactcgatctcctgagtagctgggaccatgggctcctggcattgtgcctggctgtttagtggttttaaaaaataattctacaagtatgaaaaacaaaaaagtgtaattaagaaaattaacatcttggctgggcgcggtggctcacacctgtaatctcagcactttgagaggccaaggcggatcacctgaggccaggagttcgagaccagcctggccaacatggcacaaccccatctctactaaaaatacaaaattagccaggagtgatggtgggtgcctgtaatcccagctatttgggaggctaaggcaggagaatcctttgtgcctgggaggtgtaggctgcaatgagccgaaattgtaccactgcactccagcctgggcaacagagacagactccatctccaaaaaaaaaaaaaacaaaattaacatctctagtgttaaccactcttttcattttttatgaattttttatagtcttttctatgcatgtagtttttcatttaaaaaaaaattaggttcatattacacatgctgtgttcttaccagcccttttgagttaacagtgtcaactttccatattaacaactgtgtacctgcatcacttttttttttttttttttgagaaggagtctcactctgtctcccaggctagagagcagtggcgtgatgtcagctcactgcaacctgtgcctcccaggttccagtgattctcctgcctcagcctcccaagtagctgggattccaggtgtccaccaccatgtccggctaatttttttgtacttttattagagacggggtttcaccatgtcagccaggctggtctcaaacttctgaccttaagtgatcctcccacatcggcatcccaaagtgctaggattacaggcgagagccaccgcacctggcactttttttttttacagcttgtgtcttaaccagttttatggaagtaccactatttagccaattccctgttattttgttgtatatatagtttgttttcaattttgtttcattataagcagcgctactgtggacggtcttatagttaaacctctaacatatttatgtatttagtttacactttgggagtagaattttaagtacaaaacctaggtatattttaagtgtttttgttactgaatgcccagttccattcagttcaacacaaatgaaatacgtcaaaggttttataacaatctgaaattctaccagcaatccataagaatacttattttcttctatttttttttgagacggagtttcgctcttattgcccaggctggagtgcaatggtactgtctcggctcaccacaacctctgcctcctgggttcaagcgattctcctgcctcagcctcccaagtagctgggattacaggcatgcaccaccacgcctggctaattttgtacttttactagagacaggaatttctccacgttgctcaggctggtctcaaacttccaacctcaggtgatcgacccgcctgtgcctcccatagtgctgggattacaggcgtgagtcaccgggcccggccgagaatacttatttccgtctacactaacacgggatgttattttattttattttttgagacaaagtctcgctctgtcgcccaggccggagttcattggcacgatctccactcactgcaacctccgcctcctggtttcaagcaattctcctgcctcagcctcctgaatagctgggactacaaggcatgcgtcaccacacccggccaattttttatttttagtagagatggggtttcactatgttggtcaggctggtctcgaactcctgacctcacgtgatccgcctgcctcggcttcccaatgtgctgggagtacaggtgtgagccaccatgcccagccggatgttattattttttaaaaaaactttgctaattataggcaaaaatgctatttgatccatttctgcaattttggtcactagtaatgttgaactttttgtcatgttgactatttgcatgtttttcctttttatattgtcggttaatgtctttgcccatttgccttctgggcacacagttttagagaagcctgttcactttcatgaaatgtaaataaatctgaaacaaattaaacatcaattatagtttaaaatgctaataaaaattcttattttcagccaggtgtggtggcttatgcctgtaatcccagcactttgggaggccaaggtgaatggatgcttgagctcaggagtttgagaccagcctggacaacatggtgaaaccccatctctaccaaaaatacaaaaattagccagcggtggttgtgtcctagccactgtggaggctgaggtgggaggatggcttgagcccatgaggcagaggttgcagtgagctgaaacaccactgcactccagcgtgagagacaggagtgagagcctagctcaaaaaaacaaaaacaaaaacaaaaacaaaaaggtcctttgagtaccagaaaaattgtcaatgggaatactttcctcaaggtcttgaaaattaataataaatcaacaaatcattgatggtagtggctggtgttgctttcttctatatctagctagttatcactgaacaaacattttctaaaacattttcgatgtttcagagcagagatttcaaattgacagccaagggacggattcatgcataatttactctcttttattttgctttatttttcttatggtatttacaagtaattaacatacattatatagctacttatctctctgttacaataggatataagatccacaaaaatagccagacacaatggcttatgcctgtaatcccagcactttgggaggccagggcaggaggatcacttgaacccaggtgctcaaagaccagccagagcaacatagggagatcccacctcttcaaaaattaaaaaattagctgggcgtggtggtgcatgcctgtagtcccagcagtttgggaggctgaggtagaaggatcacttgaacccaggaggttgaggctgcagtgagccaggatcatgccactgcattccagcctgagggacaaagtgagacctacctacctcaagttaaaaaaaaaaaatccgcaaaaggcaaagacttaatcccttttaatgattattgtatctccaatttctaaaatactgtgtggtatataatgcaccttcagaaaatatttgttgaattcacgcatttagtaattatttattgaactcccactgcatcctaggcactggattagctagacttgggaggtaaatgcctctgcctccatgtagtgtctttaaaatatgattctcggccgggcatggtggctcacacctgtaatcccagagctttcagaggctgaggcgggcagatcacctgaggtcacaagatcgagaccagcctggccaacatggtcaaacccggtctctaataaaactccaaaaattagccaggcatggtggtgggcacctgtaatcccagctactcaggacgctgaggcaggagaattgctcaaacccaggaggcagaggttgcagtgagctgaaatcaagccactgcactccagcctgggtgacagaacaagactctgtctcaaaaaataaataaataaaataaagtatgatgctcattaaaaccagattgaaaacaatggaaatgttttggaaataaaatatacacactgtgccagtatgtggattcattactcattaattctatgactattttttgagagcctatttgcagtcacttggggacacaataatattaaagacagattctgtccctgcggatatggcattgataatctatcaagggaggtagacattaagcaactaattaatcgtgattgtgccaagtacataaaggagaaagacaggtgcctataagcactcatgagatttccctgagaaaatgatacttacacttctaccaaagggattagaagttacacaagacaaaagggaagggaaaaaaagaacagtctcatcgaagaaaacagcttgtcaggaaagatcttgctgtacagaaagaccaaggggggcactgtggctcgcgcctgtaatcccagcactttgggaggccgaggcaggtggatcatttgcgctcaggagttggagaccagcctaggcaacatggtgaaacccacaaaaatacaaaaaaattagccaggcatgatggtgtacacctgtggtcccagctactcgggaggctgaggtgggaggatcacttgagcctgggaagtggaggttgcagtgagctgtgttcacaccactgcactccagcctgggtaaccaagtgagaccctgtctcaaaacaaaaacaaaaagaaacaacaacaacaacaaaaagaccaagagaataatcaagggaataatgacagccagagaccaaagaggtaggcaggggccatattctatactcatgggccaagtgaaggatgctcgctttattccatggacagctgaaggtttgtaagcagatgatctgatttctacattaaatagatgactctggtttctgtattgagaatggtttggctacacagactgcttagatatggcagtagtcaaggcggtagcaacggaaatagagatgcagacagctttgagagatatttaggaggtggaagtggcaacactgattggaaggggttagggaagggaaagtgtgagagagaggaagacaccctggttcctggcgtgaacagctgggtggatgatggggagcttttatgggatgtggagtgcgagaatccgtggtttagggtagaagacgagttcagtgcaatcaaggcacagctataaatgtgtacaactgaggcagaagtttcagaagcaatgagtacccttactaccatagaagatgctctgattttttttcttttttctttttttttaagaaatttttggctaggcatggtggctcacacctgtaatcccagcactctgggaggctgagttggatcatttgaggtcaggagctcgagaccagtctggccaacatggtgaaaccctgtctctactaaaaatacaaaaattagttggacatggtggctcacacctgtagtcccagctacttgggaggctgaggcataagaatcgcttgaacctgggaggcagacattgcagtgagctgagatcacaccactgcactccagcctgggcaacagagtgagactcggtctcaaaaaaaaaaagaaaagaatttttttacccaatagtaaaataaccaaccaatgcgctgatattttttaatcaactttgttgaagtatgttttacataatagattttcatatgttttacataatataataaaattcacccatattacatgtacagttcaacaggttttgacaaatgtatatacctgtgtaaccaccacgattaaaatacagagctcttctgtcatttccaaaaactccccagcaccccttggcagtcaattccccctccatctcagccccaggctttctgtcattatagtttgcattttctagaattccatataaatgaaaccatagagcatatatacagtatacatatgaaataggtattcacttgtatctggcttttttatttccttggagacagggtcttgctgtgtcacccaggctagagtgcagtggtgcaatcacagctcactgcagcctcaacctcccaggcttgagaaatcctccattcccagctaattttgtttttttttttttggtagagactgggtctctctttgttgcctaggctggcctcagattcctgggctcaagcaaacctcacacctcggcctcccaaagtactgggattacaggctccaggccatgtatctggcttctttcactcagcataatgtttttaagattcatctatgacagggaccagcaaactagggcctgtgggccaaatctggcccagtacctgattatgcaaaggcctaagagctcagcatgactttatatttttaagagattgaaaaaaaactcaaagaagaatattttgtgacacatgtaaattaaatgaaatccaaaattcaatgtctataaataaagctttattggaacacagcaacgctcacttgtttacatactgtctgtggctgtttccatgctacagaatcaaatacttgagaccgagatcgcaagaacctaaactacagcttgcaaagcctgaaatatttacaaccaggccctttacagaaaaagtctgccaactcctaatctgtggtgtcccatggatcaataatgtactccctttacttgcagtacagtactccattccattgtagggataggccacaagttgtttacctgtttgtctgttgatggacatttgggttactgcccaattatccttaatccacgtgatatgctctgatgttttgcatcctatttcattttttaaaaaattgctactcatgacccaatggttgatatcacaacccactgatgaactactctcagtttgatatagatgttaattgaaataatggaggatgaaattatgtagaagaagaaatcaaaaggactttccaggctgggcacagtggctcacgcctgtaatcccagcactttgggaggctgaggtgggtagatcacctaaggtcaggagtttcagaccagcctgaccaatatgatgaaaccccgtttctactaaaaataaaaaattagctgggcatggtggcacgtgcctgtaatcccagctactcaggagtctgaggcaggaaaatcgcttgaacctgggaggtggaggttgcagtgagtcagcgagactctgtctcaaaaaaaaaaaaaaaaaaaaaaaggcttgccagctgagtgctgaggaaatccaacaatgaaacattgggtggaggaggaggaaactccaaaagacattgagaaggaacaggcagaaagggaaggtgacgatccggagaatttgatattgtgggaagcatggaaagtcagtttcaagaagaaagtgatcatctggttctagggctgctgagaggtcaggtgtgatggactgagatggttttagtgacactggtttgggtggagggaacaaggccgaagctagattcagatgagttggtggtgcttgtgtgatgagaaaattgagaccattaggtgtaaccagaaggggatgtggatgaagataaggagtttttatttgcttgttttttgagcataagaatgtttaacaaacactaaaaggcaagcataaccagaattttacagatgaggaaactaatataccaagaggttaagtaacttgcccaagtagttttcacttatacagcttaaaaaaaaaaaaaaaaaagaatccagttctacttgtagccacagtctgaactctaaccaatgggctataccatcgacaagggaaaaaactggcccagacataatccaatttttgtacctttgagttaaaagtctacagttgaggctgggcctggtgtctcacgcctgtaatcccagcactttgggaggccgaggtgggtggaccacctgagatcaggagttggagactagcctgtccaactagtgaaaccccgtctctactaaaaatacaaaaattagccaggcttggtggcacgcacctgtaatcccagctactcaggaggctgaggcaggagaattgcttgaacccgggaggcggagcttgcagtgagcagagatggtgccactgcactccagcctggcgacagaacgagactccatctcaaaaaaaaggaaaaaagagaagtgtttgaggccaggctcggtggctcaggcctgtaatccaaacactttgggaggccgaggcaggaggatcacttgaggttgggagtttgagaccagcctggccaacatggtaagaccctgtctctactaaaaatacagtgtgtgcgatggcgcacgcctccagtcgaagctactccgggaggctgaggcagcagaatcacttgaaccggggaggcagaggttgcagtgagccaagactgcgccgttacacttcagcctggacaacagagtgagactcgtctggaaaaagaaaaagaaagaaaaagacaggtctgttagcagcacataaagccatatgtcagtagagattaaacctccccacaactgatggcttcatgctccaaactgtacaatattctgcttatctctcttcactagtccatagaatgttgcattataatgtatcagttttcctatctgtgcatccacaagccaaatggtttcaacttttttttttttttttcggggatgggggaatcacagacttgagtatataatgaagacaatggatgttttccccagaaaaatgcactcactcacacacaaaatgttgagtatagtttcagagacctccatctgcatcccaaagtaaaaacttctacccaaaatagtgtttttcttcagggcagagagcttgtctttgttttgtgtgtgtgtgtgtgtgtgtgtgtgtgtgtgtgtgtgtgtgtgtgtgtagacggagtcttgctcttgtcgtccaggctggaatgcagtggtgcaatcttggctcactgcaacctccgcctcccaggttgaagcgattctgctgcctcagcctcccgagtagctgggattacaggcgcacaccaccacacccactaatttttctatttttagtacagacgagggtttcaccatgttggccacgctgttctccaactcctgacctcaggtgatccgcccacctcggcctctcaaagtgctgggattacaggcatgagccaccgcgcccagccttttttaaatttttaaattttttattatattttgtttttgagacagagtctcgctttgtcgcccaggctggagtgcagtggtgcgatctctgctcactgcaagctccgcctcccgggttcacgccattctcctgcctcagcctccagaatagctgggactacaggcgcccgccaccatgcccggctaatttctttttgtatttttggtagacacggggtttcaccgtgttagccaggatggtctcgatctcctgacctcgtgatccgcccgcctcggcctcccaaagtgctgggattacaggcgtgagccaccgcgcccggcccagcctcttatttgtatttttattgttttttgagatggagtctcgtcttattgcccaggctggagcgcagtggcacaatctcggctcactgcaacctctgcccccggggttcaagtgattcccctgcctcagcctcccaggtagctgggattacaggtgtttgccaccacgcccagctaattttttgtatttttagtagagacggagtttcactctgttggccaggctgctcttgaaccagcctcttattcttttacatactatttccagcacaactgtccaagatggcagtcaataaatgtttggctaaatataataaataatacggttgattatttccactttttcatgttgggttttcaaagtctacttttaaaacagtaaagttaacttttctctctagtatttgttttgtagaatctattatactttgtaatgtaatccacagaaacttggaggtgactttagtaaaatttactagttttgaatgatacccatgctgaggtgctcagaggtgaaatgtactaacatatatcgatggatggatatatggatgcatatgtgattaaagcaaatatagggaaaattaactgtagaatctaggtagtgggtatatggttgttcactgtacaactgtttaaacttttctacgtttgaaaaatttcataacacgttggaaaagtgacttgttttgctcaagcaggggtacattcaatcttcaattcttgaaagacataaatctatctttccttctgtttggaaagctctttagagagtcagaataatccccacagtacagtctaaaccagcacacaagggttttttggtagaaaataattttattaacataaccaggcaatttaccaaatacaacgtagatagctcaaaacatggagttactgcgctgaaaatgtgaccctgtttacacagatttcgggacgaagagtataaaacaggagagaaaaggagtaagattgtggttgtagcgtcatcgcagaggtgaagtgttccattgattgccactgtggtagtctatatcagtttcccacattaaggtgggaggaatctactaagcaaatgtacgccctccccattcgttcgaaacacattgcagtaaaattgcaaaagtggccgggcgtggtagctcatgcctgtaatcccagcacttggggaagctgagacgggaagatcgcctgaggccaggagtttgaagccagcttgggtaacatagtgagacacccctaccttctctattaaaatgagattttaattttttttctcttcagttcatcggttaacaagataaaaaaattaataaaaaattaactttttaaaacatttaaagtaaagtaggagtggaagcagtatgtggactcatggggcttgggtctgaatcctacctagatcggcactgcgaaatggggataatgatctcctagagctgctgaaataggaaaatggaagaacagcagctgatgtattaatattatcattattactactacccattacctgacaagtgataattgtgacatgaaagaggctggaccggttgttacaacaattttttccgtctagaattcggcggtaaggtctgagacaacacctcagcttagatcagtgccttctctgaacagcgttcactaagcagcccccaaccccaaaacccccaagtccccgggcgccgaggacgctgcgagtcctgcgcatgcgcaaggttgcccactcgctcaccgcctccttggcgaatggcctgttccattctcgagggatgccggcgggaggtgaggcgggagacttggaagcctgggcccggaagtgaggtgcgtcactagtatttccagcctttcactccatgaatagtactttgtgattattatacttctaccttgatgattgcaacaggctgctggaaagagtttggtgaacaatccaccgggcatcctccccccttcacctgcgcacgttagggagggccggcgtggcgcccaggtacggaatcccagagggctccgcccagcgctacggggccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaaggtccgtgccgggagggggcgatggggacggtgctgcggcccggggctcccgcttccgaggcaactgtttcccagtcgcgagctgccattgtgacccggacagggggacgcgggctgacaggccctgcctgaggaggcctcgccgggagggcggctggggcccgggcgcgtcacggggccgggtgtctcttgggtccccgtgggccgaagaggctgggcggggttcggtgggggccgcgacgggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctgtaggtttttcttggtctccgagttaggaatgaaaattgccaaagcagtggttttccaacttcagcctgagtgggaatcacctggggcctttggtaaaatgcggaggttcagtcccggggtcagaacctctgggggcgggaccgggaactgcgtgtttaaccgccaccgccccgctcccactccgccccacgcaggtgattctgatgctgagcctgcgatcaccgggcgagaacctctgagttccagaaaggggtgggtgttgcgtagattgcgaattgagttttggggatcgcagctgctccacaacttcctggctcccccattccagtggcgaggagggatccccgagtcaactcgaaatccactggtaacagagcctacctctggtttccccttgggggaacggcagcgtggtgtaccaggctgactgctctaccatgtgaaacggattctcattgtcccagtgttagggcttgtaaatggaaaccagtttgggtttcttcacggattcctgctttcggtacctgacattctgccctccctcaaagcccttctgtctgttccagcttgggagtctgcttgtccaatccagtgcatacccggtttttcatgcatgtggcattcaggagcaatgctcgtgttttaagacggctacattttaattttgagctggtaggaataatatattttgtcttttttcaaggcagcagctgctgtagattttgttcacttgtcactggagagttgaaggcaataattgtaaaggttgggccagatgtcttcatgtgctcacagtggtatagcctactcctgggttgcttagcataaattgggtggaagacaagaaaaagataatatggttttcttgtgccatctctggggtgaatgttacgtgttttcctggctgggaataaagtctttccggtcgtctgattagcagggtgtctaccttttggtactttgagtttgtccagatgagtggttcttaaagcagggggcaatttatttccccaggagacatttggctatctctggacatagttttgattgtcacaatgggggcagggaggtgctgccggtacctagtgggtagaggccagggacgcctctaaacatcctacgttgcacaggacagccccccacgctggagaattctctggcccaaaatgtcagcagtgttgaggctgagaaatcctggtcaagatcatgtttataacaccagcagttgagtacaaaacgatgcaaagtggtgttatcaatttcctaagaaggtgggtgggcttcatgtgattgtaattggaatcctgaagaactggggtgatctttcctccaggaataattagcctttataggaaaatctgcagggtgggtcagaatcctgctttaaatattacttttctggcatttgatcagtaggttacagtagttgctccctaagtgttaattgatgataaaagatcttaaactctctcaatgaggatcgcaagagggactgaaattccagtgtgtttaatattggagcattcacaaaaattgtagtgatcttttaggaattcagaacgtgtgggctggaggtttctgccttaggtcaatgtgaaaattctgagtgtaagtttttcagaactatgggacttacttttttttttttttttttttttttttttgagagggagtctcggtctcttgcccaggctggagtgcagtgaggcgatctcggatccctgcaacctccgcctcccggattcaagtgattctcctgcctcagcctcccgagcagctgtgactacaggcgtgtgacaccacacccgactaatttttgtattcccagtagagatggggtttcaccacgttggtcaggatggtctcaaacgcctgaccttgtgatccttcagcctcagcctcccacggtgctgggattacaggcgtaagccactgcacctggccgggacttagatttatattccctgaagtaatacagggccttagatggaataaacgatttatattggtgctaattgggcagaaaagaaaaagcattgctgtaatatgaatgttgatgactttatgttctgaaaaatagtctgggtcaaagtgaaacatttaattgtgttcattattcctgtttctttgaggaatagactatcctgcgttaaattctacattgttaatataaactcaagagctatgtgagcagttgtaaatgatcccatttaaactgattgttgcataatttatactgattacagaaaccacaatgttatttgatgctcaccctctaaaatttaaaataatatctctcactttaaaatgtatgtgaaaaaacaaaaacaaaatgtagtatgcgatcatcatttagtagaatcactcagtgatttggatttggtccaaatatagttctgtcccttgctttttctgttatgtaaacgtgcagacctgtgataacagagccattttctcgtcacgatttgcttttcttccacaacagtatcagttttcttgtatctgagatcagtgatgtcccaataaatcagatgggttaattgaggaggcaaaggaaattcaaacttaggagagtaggagtaggggctttgcccctgccccccactgtatgtccaaggcataaggaacaaggccctgtagcagagtctcacagtgtgtacttatgttaatattcaataaggaaaatgccacaggaagtaatcactataatgatgaagattttaagttattaaacacaccttccagtaaaaacctgttatattattattatttttgagacaggatctctctctgtcacccaggctggagagccgtggtacaatctcggctcactgcaacgtccgtctccagggctcaagtgatcctcgcgcctcagcctcctgagtagctgggactacaggcactcacccccacactgagctaattaaaacaatttttttgttctcgagacaaggtctcactatattgcccaggctggtcccaacctcctgggctgaagccatcctcttgccttagcctcccaaagtgctgggattataagcgtgagccaccgtgccaggccaaaacctgctactctaaacttgtagaatagcccagacctttttctgttggttaaaagatctcattcttcctgggtattatgtttaggcaaggtatactgcagtttgtttgcatttactttaattctgtccttgagcaaacttaaagcagtttctcagcgtcagcactagtgatattttgggtcagataatttgctgttatgggggctggcctgtgcatggcagcatgcttagcagtgtcccagacctctgctcagtagatgctagtcgcactccctacacccagttgtaacaataagaaatgtctcaagatgggggcagttgtcccccaaggggtagagggaattgcctgtcattgaaagtccctaatttagggaatctagagctacagttccggtttggtcaccactagccatatttggcagtttacattgagattaaaattaaacacaatttaaaattcatttcctcagtcatgctagccacatttcaagtgctcagcagccacatgtggctgatgtctgctacactgggcagcacagatgtggaacatttccatcgcaaagaaggttccactggacagtgctaagagctggcaattcgtgttttttttttgagatggagtctccctctgacgcccaggctagagtgcagtggcacagtctctgctcactgcaacctctgctttccgggttcaagcgattctcctgcctcagcctctcaagtagctgggattacaggcacccaccaccacacctggctaatttttgtatttttagtagggatgggatttcaccatattgaccaggctggtctcaagctcctgacctcaagtgatccacccgcctcggcctcccaaagtgctggggttacaggcatgagctactgtgcccagccaattacttgttatatctaattctcatctctgaaagaggcaactttgaccctgtttctgacctaaatcagcacaactcagcccatttttggttcttgaactcatcctgagctaagtgtttctttcctgctatttgggactgattttagaaaattctttgtcaccttgctgttatgctagaggtttatagcagcatcaatggaacattcctgatcattacttactgataaggactccgagaatttctattcctgctccttccttaaaaagcatgagaaaagaacccctgttaggcaaggttgaaatgaccagtttccgtgtatggctttgtagatcccactcttttatatagaatgagaggagatgagaggctgtaattgtagctttcatataaagccaattccaatgttacaatgtgagggttttgcatacagatgcatggtggctatggctgtaaatgattatctaatactggctgtcagggaaaactgatgggactcggccatagtacaaagttcctgatcctagatatttatggctttgttcattcttgatttattcaattttgcaggggaagtcagtggcagagctattgatggtcccatttccgtctttgctccactatatctaggattatatgagttataggtagaagttggttgagcttgatttcatctgttgtcacctaaagcagaaacctgttttgatttataattttttttttttgagacggaatcttgctctgtcacccaggctggagtgcagtggtgcgatctcagctctatgcgacctctgccccactgcaacctctgccccctgggttcaagcaattctcctgcctcagcttcccgagtagatgggattatttttgtgccacgcccggctaatttttgttttttttattttttatttttttgagatggagtctcgccctgtggcctaggctggagtgcagtggcacagtctcggctcactgcaagctccacctcccaggttcacgccattcttctgcctcagctgggactacaggcgcccaccaccacacccagctaattttttgtatttttagtagagatgtggtttcaccaagtgttagccaggatggtctcgatctcctgacctccacctcagcctcccaaagttctgggattacaggcatgagccaccgcgcctggccaatttttgtatttttaatagagacggggtttcgccatgttggccaggctggtctccaactcctgacctcaagtaatctgcccaccttggcctcccaaagtgctgggattacagatgtaagccactgcacccggccttgatttataatttttattaatcgaaggtgagctgtggtcaaagcccaatgctgagtgctgacagagacacaaggtgagtaagatgtggcccctgcaggaggttgcgttctggtaagggagtatacttttttttggacaaatccttgtatagaaagggataaaaagcataggaattaagaaacaaattgtgagtgcaaggagcaagtgaccaggaaggattatgtgaaagagattctttaggcagaatatttagctcagaattatgcttttctagagtttaattgtaaatataatgcaaacctttactttacgagtgtgcctcatattattgctggtagataaaaatcaagaaacaggaaaagcatttcatctttacctttccgatttgatcgctccctaacaatccctgaacaaggtaaatcctgaatggtgataatcattcaaccttcatctctgctaaaagcatttcttttcctcccaggcaaaaacaaacagtgcctgctgtctagcactagttaaactagttaaacactgcctataaagcttatcttaaggaagagttataacagtatctgcttctgtttagcagttttctttttgttccagaataaaggtgtgattccaggtaaacagtaaagtttttagaaatagagcttccctattgtatgctatttttccatcagtgtcattatctggaagtgtttactcgtgttataagatctgtgtgaactgacactgcagtagtggtctctgggaacacaggtttttggaacacggagttggatctctagcatctccaacgtatatctgagtcaagtgattagaggctttttccctccttcacatactgctctctgactgagatgtgatctgtgcagttaactttgctgcctcctttccactgttgggtatttttgtccttttcttttgtttcttttttttttttgagatggagttttgctcttgttgcccaggctggactgcagtggtgcgatcttggttcactgtaacctctgcctctgggttcaagcaattctcctgtcttagcctcctgagtagctgggattacaggcgcccaccaccgcgcccagctaattttttgtatttttagtagagacagggtttcatcatgttggccaggctggtcttgaactctgtacctcaggtgggccactgcacccggcctatttttgcccttttctttcctattttctgcctatcttcttgaggaatttgtaaggttaaatacttatagttacaccttatacagtacttggctaacccttttcaactaggaagattatgatgcttaatcttaatgagccagtaattacagtatgtcttcatattctcacagacacactcaagcgtagagaccatgatggttaaaaataagactttcaaatgacaatatccagttcttagaagatgagaggagacggctgagcatggtggctcatgcctgtactcccagcactttgggaggccgaggtgggtggatcacctgaggtcaggagttcgagaccagcctggcccacgtggtgaaaccccatctctactaaaaatacaaaaattagccaggtgtggtggctcacgcctgtagtcccagctactcaggagattgtgccactgcaacagagtgagactccatctcaaaaaaaaaagaagatgggaggagacaaaagttctggttcttaaatactgtactgttgaatcaggcaaaaatacttacaaatgtagaaactgagactccaataagataaaccaggtttacaagtcactgtatcagcttggaggattcctgtcctcttctctcatccttggcccataaggaacattatgttcttgctgtggcttctcagtggtatgtattataatagacgtgtgtggtgtttggggaacttgtttaactagtgctagacagcaggcactgtttgttttcgcctgggaggaaaagaaatgctttttgcagagatgaaggttgaatgatgatcactattcaggatttaccttgttcagaaagctgtgggaggcaagagtagttaagttaggaacagctgtctggagctttacctcttgctttttatctcagccgaaggtaggtagtgattttttttatgtctaatgcatatggtataaactagcatctcataactccaaggtcttctaatatgagcagctggtttctctttagttagccctaagaggcctctgaaataagtcctaaaagtcccccaaataagaacattcctctcctgaaaaaaaaactttgttgaaacgaaagtattatatacttctagcattgatgaatgttacaattaatatacttttaaaaataaattttagactttctttgttatagaggctgcttctcttaaaagccttctcttggccgggtatggtggctcatgcctgtaatctcatcactttgggaggccgaggcgggcagatcatgaggtcaggagatcgaggccatcatggctaacatggtgaaaccccgtctctactaaaaatacaaaaaaactagccgggtgtcgtggcatgtgcctgtggtcccagctaattgggaggctgaggcaggagaatcgcttgaacccgggaggcggaggttgcagtgagccgagatcatgccactgtactccagcctaggcgacagagcaagactccgtctcaaaaaaaaaaaaaaaaaaaaaaaaaaagccttctctttgaaggcttagctctgtatgtcttaaacagcagttattcatgtcagttattcatgtaccatctgtgaatttggccacatcactgtaccacctatactattatttgcttagtattttcttttaaatctactttacatcaatttactccccctttatgaaaaattgaggaaccgtttacttacaacaaatagacccattttaattatatagtttgtgttttggaagttgtatatagtgatattaccaccagcatgatcaagatacaaagcattgacctggtgcagtggctcacacctgtaatttcaacactttgggaggccaaggaaggaggatctcttgagcccaggagtttgagggcagccagggcaacacagtgagactcctatctctataaaaaataaaaacttagccaggcttggtggcatgcacctgtagtcccagctacttgggaggctgaggtgagaggatcgcttgagcccaggagggtgaggctgcagggagccacgatagtgccgctgcacttggcctgggtgacagagtgagaccctgtctcagaaaataagtcccctacccacccaccccaaaaaaggtacagagcatttctgtctccctgaaaatgtccctatgtccctttgcagtggatccctgccctgctttctgtcactctagacctctttacccacccatcccatccctgcacccccgcctttttttttttttttttttttaacttagatttgtcctcaactgtaatgtctctaaattctgggatttgaggtgtgtgtttgtgtgggtttttttttttttttccaaatcacataaaagtgagagagagagagagagagagtgtgtgtgtgtgtgtgtatacatatatatatatatatatattttttttttttttttttctgagacggactctcaccctgtcgcccaggctggagtgcaatggcgccatctcggttcactgcaacctccgcctcccgggttcaaacgattctcctgcctcagcctcctgagtagctggggttacaggcacaccaccacgcccaggtaattttttgtatctttagtagagacgagatttcaccatgttggacaggctggtctcaaactcctatcgtgatccgcccgcctctgcctcccaaagtgccagaattacaggcatgagccaccgctgccagccaaatgtataattttttaaattcacactttggtgaactggtttaactgaggaaaagtgttgattcgtgtgttttcaaaagatgaaatttttttttttcccctgaaacagagtcttgctctgtcacctaggctggagtgcagtggtgcattcttggctcactgcaacctctacctcctgggttcaagcgattctcctgcctcagcttcctgagtagctgggattacaggtgcccgccattgcacacgactagtttttgtatttttagtagagatggatggggttttaccatcttggccaggctggtctcgaactcctgacttcgtgatctgcccaccccggcctcccaaagtgctgggattacaggtgtgagccactgcctaagatgaaaaaatttttaaagtgactagttcattaattcccaaatcttaggctctaaagacaccttttatttctattgtagttaccagttttggaagatatgataaacaacttttttttttttttttttttttttgagacggagtcttggtctgtcgcccaggctggagtgcagtggcacaatctcggcttactgcaagctccgcctcccgggttcacgccattctcctgcctcagcctccctagtagctgggactacaggcgcccgccagcacacctggctaattttttgtatttctagtagagacggggtttctactgtgttagccaggatggtctccatctgacctcgtgatccacctgcctcggcctcccaaagtgctgggattacaggtgtgagccaccgcgcctggccttgccaatttataattttccgttagcttttttgaaaagttgagagttgctccttgacctcctttaccatcttaccttgcatttgattcttgacttttcctccaacatttaaattgtcagaacttttaagcaattttaacattacatatgtaatatttcttctggtagtgagggagtattttaatatcccatactgtctgataaaaatcgcctagcataaaaacgattcttggccaggcactgtggcccacatttctaatctcagcactttgggaggccaaggcaggaggattgctcgtgaagccaggagtttgagatcagcctgggtgacatagtaggaccatgtctctccaaaaaatttttaaaaattagctaagtgtggtggcatgtgcctgtagccatgtctgctcagggggctgaggttagaggatcacttgagcccaggaactcaaggctgcagccagctatgatcacgccactgtgacagcctggacaatagagcgaggtcatgtctcaaaaaaaaaaaaagtttgtaaaaaatgctcacgaaggtatgaatagtagggcttgttttataaaatgagctaactattaaagtctcagttctggctgggtgcagaggctcacgcctgtaatcccagcactttgggaggccaaggcaggcagattatctgagggcaggagtttgacccggccaacatggtaagatcccgtctctactaaaaatacaaaaaaattagctgggcgtgatggcgggcacctggaatcccagctactcaggaggctgaggcagcagaatcacttgaacccgggaggcggaggttgcagtgagccgagatcaagccactgcactccagcctgggagacagaatgagactgcatctcgaaaaaagtctcagttctgtgacagtgagcatgcaattgaatggctcttcttaggaaaggagaattaaatcatacctatcatgcaactgtgttagataaaattgtagcaaaaatattgaacccacgtcatttatacaacagaattaactgtacttgaaatataatttatgaatttgtagagaggtaaaactgtgtctaaattctcagcaattagtatctatcagaaaatgtgcatgtagatatacccactctgtaaatgctttgttgcactttttttggttttgggatttttgtttgagacagagtcttgctctgctgcccaggctagagtgcagtggcgcgttcttggctaactgcaagctccgcctcccaggttcgagtgattcttgtgcctcagcctcctgagtagctgggactacaggcgcacaccgccacgtccagctaatatttgtatttttagtagagacggggtttcaccatgttggccaggctggtctcaaactcttgacattgggtgatctgccctgctttggcctcccaaagtgctggttttacaggtgtgagccaccatgcgtggccatgctttcactcttaaaaatgcttgggtttaagagttggtggaaaaaggaaaaaaaaaaaatgccctgatctggatgatgagtttacggccatctggttgagactgttgtaaagtagaaattttccctgtaaagtgtcactttcttcccaggtgaaaacattaatcaagcaaggataatctttaaaattaaaccttagttctaaatatgatttttgagtacaagcttttttaaagtgttgagttgcttcatttacttacttgataaaattgagaagcagtattgcccagtggttaagagcactggtcctagaattttacttagttttaaattctggctctaaaatgtactatgatttggggcttgtgaggaagtaatgtgtgtagaggcgttaattattagcacaatgcctggaatatagtaagcaacccagtaagtattagtaattataaggatcataaatctgattgaatatttactctgtgtctgaccctgcactcagtgctaagggattcagaaattatttgacattcttccgaggaacttgacatagaatactgtttttcctttgtttttttgttttttgagatggaattttgctgtcgcctaggctggagtgcagtggcaccatctctgctcactgcagcctccgcctcccaggttcaagcagttctcctgcctcagtctcccgaatagctgggattacaggcaccccccaccacgcctggctaatttctgtatttttagtagagacggggttttgctatgttggccaggctggtctcaagcacctggcctcaggtgatccaccaaccttggtctcccaaagtgctgggattacaggtgtgagccactgcgcctggcctgttttttttttctgccaacattatcaaacattttcctatgtactaactaatagacatctttatacatctttatacaattctttttttttttttttttttgccatacaggttcattttattgagtggaaagcttacaaaaggtccactggccccttccctccccacgtgacactcattccttccaatgcaaactctggtgtatccacactcgcttctgcgtcactggtttcccccaacaaggcacaaagggcgggtgcttccaaaggatcccttgctcctggcagtgggactttcagtgctgggtgtcttgtgcaaatggtggctgaaagcaggactgttagttcactcagacactgggatcttccttactcctgcagaggggcttggctccaggcccacagtactcgttgtagatgagcttgaagaggaagaggtggaagagggtgatgagggaggccaagctgaaccagaagaggaagggcagcccggggtcctgctgagccatgtgctcatcatgggccaggatggccttgaggtgcagcgtgtgccgcaggtcctgcaggtgtgtgaggtcggtggagatgtagagcagtggcgtgatgggctgtgtcaccatgaccgagaaggtgtggcccgtgggcgccgaggtcagctccactggctcgtccaggcagcctgccttgcaggcatagatcttgacaggctggccacgggactccacggactcgtgtaggtagggcttgccctcggcatccgccagcacggccaggttgatatggtcgttcttgtagcggatgccatgcaatgcatagctgttctgcagcacgtcggggtcggcctggaactggaggtggttctctgtgaactgcagccccccgaagctgagcaccatgccctgcaggatgcctggggcacccaccttcaccagccccttgcagccactcttctggagggtcagcctccacaggtcagagagctgcaggatctgctggacggaggacagcagccccggccacaggttctcggcgtgcatggtggcgtgcccgctgaagcggtgatcttcatagttgagcgtcgactccatctggtctcgctccctgtggctcagggaggggctgagcagcggggctggcgagcaggagagcatgtaatagagcgtcaggttcacggtgaggccagacggcctgtgggtgtcagtgatcttcatttccactcctgggctgaagagctgagcccagaggagctggtggtcttgaagcagctccgccgctggcatctccaagagctccagcatttccttccgtgccaagtcctgcagcgccttgagctccttggctgctttgcttttgggcacctgggggataatggggccagagacgtgcaccacccacagcaccgtctcatccagctgcgtcttgggagccacttggaggcggttcaccagcttcttggcggccaccaccaccaggtgcaccaacccagtgggcgtaggcggggaccggcctgagtagaggaggaactgatggtctccgaccttctccagggtactggtgaaggccttgggggctgggccggcagtgggccccacagtctgcagcgcggtcacgcgctccgtggggttgttgagctggatgcgctgcaggtagacgtggggtcggcccctgtgcgccagaaagccctcttgcagcagcacgcagtcgcggccggaccccgcggcaaggccagagacggaggcgggcccggggccggcggccacggggccaggacctggggaccccagctgcaggcaacgcacgcggcgcagcagcccctcccgcagcagcagcaccgcctctccagcttcagccagcgcgctcagcgggcgcagctgcacgaagggcacaaagtccggcgccacggcgggctcccgctccccgggagtcacccacagccgattggcagccacgtccagggccaggaagccgttggccaccagggccggcactccagggcccagcggtaccgcctcgccgcgctcccgcaggccgcgccaggcgcgggtggccgcctccaggcaggcagacggctcggtggcgcccggctcaccccaggaccagggaagcaggtgcaggccgcccgccgcccgctgcgcgccggaccccccaaaccacagaagcagcagtaggaggccaagcaggcagaggaggcggcgggcccagctgctcgacagcagtcccggcagccccttgagcccctgctgtagccacatcgggccgccaggcgcgggcaagggcgcgagggcggccgccgggcccgccgcccagcccaccggcccggccgcccgtgcctcactgcccggcccagaccgcggcgcccaccccggcccccgccgcaaccgccgcagcagccgccatcgctgcttcctcctccttctcctacaatttaattcttcatttaggtttgtgtctggctgttgccctggtgttgtttattaatgttgatcatacagctattttggcattgcccacagctattgaggataagaaatgtgatgaagaaagtggtagctgcccccagtagaagcttatgaagacgctgtttttagttttaagggatcagttaatctacaacttttcatagagcattcattggtttagatcttaatattatcctgaaactggataatactttatattttgaattatccaattaatgcaacaaacacgtgagggtctatggcattggagtcattgttcacatttattcacccaaacttaactatcagtgctgcttttcctacccacccactcccccctgggcttactccctgaagagcaagaatgatttatttatttttatttaattttttgagacaatcttggtctggcgccaaggctgaagtgcagtgtcgcaatttcagctcgctgcagcctccgcctcctgggttcaagcgattctcctgcctcagccttccgagtacctaggactacaggcatacgtgaccatgcccagctaatttttgtatttttagtagagacgggattttgccgtgttagccaagctggtctcgaactcctgggcctcaggtgatccgtcaacctcggcctcccaacgtgctgggattatagtcgtgagccactgcgcccggccagcaagaacaatttaaacataagccagtttacgtttacgtaaactgcatgtacactccagagtcagagattcacctggggattgtgaatctgcatttccctcctgcctttcagtttaagcatcttgtcattacacgggattttagtgtttataaatgcatgttcacacaatgtggcttctaaactattttgtgtgtatatatatgtattatatatgtatatagatatgtgtgtgtgtgtgtgtgtgtgtgtgtgtgtgtgtgtgtatttgttgttgtcgagacaggttctctgttgaccaggctggagtgcagtggtgtgatcatggctcaccaccagagcctcaacctcccaggctcaagtgatcatcccacctaaacctcccaagtagttgggactacaggcgtgcaccaccacacctggctgatttttgtactttttgcagatatggggttttgtcatattgcctaagctgtattttgtctatttttttttttttttttggtgacaggttgttgctctgtcacccaggcagtggcacaatcttgtctcactgtagccttgacctcctgggctcaagcaatcctcttgcctcagcctcctgagtagctgagaccagaggcatgcactaccatgcccggcttactttttttgtattttttgtagagacgaggttttgccatgttgcccaggctcatctcaaactcccggactcaactgatcctccttccttgacctctcaaaagtgctgggattacaggcatgagccaccacacctggcgtattttatctattcttaacagaaatattcattataattctattgaaagaaatagctgtgttgcatttagagaacagtatgttgatatccactctggcatgccttcctaagggattttcaggttaatatgacaattggagaattgagccaactttagacccgtggtctaaagagaagtcaaaattagtaggagtctgaatccttgccttcaagaagcttgtaatctaattggagagcacatttatactggaaagcacatctataaaacaattcacagtaaagggtgtaaggaatcatgaggataaatggcagccgcaacaactgcaagcattctgtcccattgtccccataaatacaaccaacattgtcaagcaacaagtctagatttttggtttaggaaaaaaggcatcagtatcattagaggggatgggaaagagcaaaagtggctttatctgtaaaggcttcctggaattattgacttgtaattgaataggtgctaggagagagatagataaaagtcatgaggatatttcagacactatggtcgttgggagcatgaaggtgtgaatcaagccaaactgtttatcatttggctaggtggtaggggacacacgggagtgtcacagcagtgaggatcgtcaggagcatcaccagctgactcaggggtgaagataaattctcttgaccatcatattcctcattctcttcactgtctgcactgaggcctttttcgagtgctttctgagccttctcatagttaaagtggtgaattttattgaaaacacttgttttaaaatttgtctattttatctaaaaatttggtcatggctaaatgattaccttgtaagcccttgtgggagccagtgtgatataatagaggtcagaaacaggagtcagggaccctaggttttggcacctcattgtcgtttattagctctatggccataggcaagtcgcttaacctctctgcatcttagtttcctcacctccaaaatgttagaccagaatcagacgtttttatgctatacttttttttttttttctttttttgagacagggttttactctgttccaggctggagcgcagtgacacaatcatagcttactgtagcctcaaactcccaggctcaagcgatcctcctacctctgcctcccaagtagctaggtctacaggtgtgcaccaccacacccagctaatttatttctcactatgttgcccaagctgatctgaaactcctggcctcaagtgattcttctgccttggcctcccaaagaattttttttttcttttcaatgacactttaaaaaaaaattttttttttaattttttaaaattatactttaatttttagggtacgtgtgcacaacatgcaggtttgttacatatgtatacatgtgccatgttggtgtgccgcacccattaactcttcatttaacattagttatatctcctaatgctatccctcctccctccccccaccccacaacaagcagcagtgtatgatgttccccttcctgtgtccatgtattctcattgttcatttcccacctatgagtgagaacacgcggtgtttggtgttttgtccttgagatagtttgctgagaatgatggtttcaaacttcatccatgtccctacaaaggacatgaactcaccattttttatggctgcatagtattccatggtgtatatgtgccacattttcttaatccagtctatcattgatggacatttgggttggttccaagtctttgctattgtgaatagtgccacaataaacatacgtgtgcatgtgtctttatagcggcatgatttataatcctttgggtatatacccagtaatgggatggctggatcaaatggtatttgtagttctagatccctgaggaatcgccacactgacttccacaatggttgaactagtttagagtcccgccaacagtgtaaaagtgttcctatttctccacatcctctccagcacctgttgtttcctgactttttaatgattgccattctaactggtgtgagatggtatctcattgtggttttgatttgcatttctctgatggccagtggtgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcaggtgagtagactgcaaaaattttctcccattctgtagattgcctgttcactctgatggtagtttcttttgctttgcagaagctctttagtttaattagatcccatttgtcagttttggcttttgttgccattgcttttggtggtttatacatgaagtccttgcccatgcctgtgtcctgaatggtattgcctaggttttcttctagggtttttatggttttaggtctaacatttaagtctttaatccatcttgaattaatttttgtataagatgtaaggaagggatccagtttcagctttctacatatggctggccagttttcccagcaccatttattaacaagggaatcctttccccatttcttgtttttgtcaggtttgccaaagatcagatagttgtagatatgcggcattatttctgagggctctattgtgttccattggtctatatctctgtattggtaccagtaccatgctgttttggttactgtagccttgtagtatagtttgaagtcaggtagcatgatgcctccggctttgtttttctggcttaggagtgacttggcaatgtgggctcttttttggttccatatgaactttaaagtagttttttccaattctgtgaagaaagtcattggtaggttgatggggatggcattgaatctataaattaccttgggcagtgtggccgttttcacgatattgattcttcctacccatgagtgtggaatgttcttccatttgtttgtatcctcttttatttcattgagcagtggtttgtagttttccttgaagaggtcgttcacatcccttgtaagttggattcctaggtattttattctctttgaagcaattgtgaatgggagttcactcatgatttggctctctgtttgtctgttattggtgtataagaatgcttgtgatttttgcacattgattctgtatcctgagactttgctgaagttgcctatcagtttaaggagattttgggctgagacgatggggttttctagatatacaatcatgtcatctgcaaacagggacaatttgacttcctcttttcctaattgaataccctttatttccttctcctgcctcattgccctggccagaacttcccacaccgtgttgaataggagtggtgagaagagggcatccctgtcttgtgccagttttcaaagggaatgcttccagtttttgcccattcagtatgatattggctgtgggtttgtcatagatagctcttattattttgagatatggtccgtcaatacccagtttattgagagtttttagcatgaagggttgttgaattttgtcaaaggccgttctgcatgtattgagataatcgtatggtttttgttgttggttctgtttatatgctggattacatttattgatttgcgtatgttgaaccagccttgcatcccagggatgaagcccacttgatcatgctggataagctttttcatgtgctgctggattcagtttgccagtgttttattgaggatttttgcatcgatgttcatcagggatattggtctaaaattctctttttttgttgtgtctctgccaggctttggtatcagaataatgttggcctcataaaatgagttagggaggatttcctctttttctattgattggaatagtttcagaaggaatggtaccagctcctccttttacctctggtagaatttggctgtgaatccctctggtcccggaccttttttggttggtaagctcttaattattgccacaatttcagagcctgttattggtctattcagagattcaacttcttcctggtttagtcttgggagggtgtatgtgttgaggaatgtatccatttcttctagattttctagtgtatttgcgtagaggtgtttatagtattctgtgatggtagtttgtatttctgtgggattggtggtgatatcccctttatcattcaatgaaactttttacaaataaaaactttactactttactcaaaaccctgttatacaaaacagagctgatctgctagggagttagaagccccaactgcttacctaacccttccttctcagagtcctcccagggaccttaaagctcaggagaacacagctggaaaatccctggactagatcccttaggtcccttctagaatgtaacaatttctgaatcttatattgataaatggagtggaatttcttaaaaacaattttgaggaggcaatgcagttttaaatacgtacgtattgtatgccatgctgtaacatattgctagatacagtgagcaataggaaaaggtaaacacagctcttcctttaagcagcacacttagaagagtaagaggggaacaaaagagctataacttatatatgatattatatgtattatatgtaatataatatataatatataatttattgttataacacaactcatactacatagagattgaagtcaacaagaattttctccctaaacataactacagagattaagaatagagaaaggaaaaggaaaggaatgcgtatgttttaattctgcaaaaagttcgggcacagtggctcagcctgtaatcccagcagaaggataacttgagctcaggagtttgagatcagcctgtgcagcataatgagaccttgtatctacaaaaaaattttgaaaattagccaggcatggtggcgagcacttgtattcccaggtactcaggaggctgaggtgggaggatcacttgatccctggaggtcaaggctgcagtgagccacgatcaaaccactgtaccccagcctgtgtaacagagcgactgcctcaaaaataatatttgtcaaaatagcttgtctttgtatcactgccacattgcttgtttgaaacgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacctggttcttcccagaatgaatggtgaaaaaattataattctgcagaaaaatttaaattctattttgtttactttttggatgggagataggtgtacacatggcactaaaattcaaaaggaacttaaggaggccaggcacggtggctcacacctgcaatcccagcactttgggaagccaaggcgggcagatcacttgaggtcaagagttcgagactagcatggccaacatggtgaaacccccccgtctctactaaaaatacaaaaattagctgggcatggtggtgtgtgcctgtaatcccagctacttgggaggctgaggcaagagaatcacttgaacccaggaggcagaggttgcagtgagcaaggtcatgccattgcactctagtctgggcaacagagtaagactccaactcaaaaaataaaaataaaaacagcggcttcctctaggaagtggggctggaagatttttactttttctgttatacttttgtactattgcaagttttaaaatcatgtatttcacagtaaatccagaagaaattatgcacttaatttttctgggtgaattgtgttatagaggtaatagaggattattaaaatttctttctttttttttttgtttcccagatagcagaccccacgttagctgaaatgggaaaaaacttgaaggaggcagtgaagatgctggaggacagtcagaggtgagtaggacagaggtgaccctgttcaacgagttcagcctgctgtgaagccagtggctctgggtcctttctgttaaaggtgcctcttggcttcacagtgtcacacacagctttggctgacttgaaaattggtatttgtcttgggtaaaaggtgccttgtaattaaaggattttgaaattgagaggaaagacttatactatttaattctgtctattaagagtttcatttacttaatatattgatttgactctataaatacttattatatattcaggtcatatagagcaccaagtaaacaagaagtgggtggaacttttttgttgcatattcttgtcttttccagaaattcaaacgatacctgaaactggaggcagggagatgtgataaatgtgtttgaaatcctgcctcagtcactgggaggttataggcaacatggtcatgtttgcatattcaggagttagaaatttggtatgatgaaacaaatgaacagctttttcttttctttaaattagaagaacagaagaggaaaatggaaagaagctcatatccggagatattccaggcccactccagggcaggtaggtggcactgaggatccatacctttagttaaggtgtaaatttttgtttgtttctgagatggagtcgtgctctgttgcccaggatggtgtgcagtggcacaatctgggctcgctgcaacctccgcctcccgggttcaagcagttctttcttgtgcctcagcctcccgagtagctgggattacaggcgtgcaccaccatatctggctaatttttgtattttcagtagagatgggattttgccatgttggccaggctggtttctaactcctgaccttcacctcaggtgatctgcccacctcagcctcccaaagtgctgggattacaggtgtgagccactgtgcccggcctacatttttcttaaaccagtgtcttatcatcattgatttatggttttagttttaatgaacacatagcaaatttaaatagacttatgtgcagtataacattagaaaactgaagtgtcgttggctggttggtgatattgctgcacctgctggcttctctccctctcccatttggaatttaatagatgctaagtacagtgggtcacatctgtaatcccagcactttgggaggccaaggacagaggatcacttgagcccaggagttcaaggttacagcgatctgtgattgtaccactgcactccagcctgagtgatagagacactctctaattttgagacagagtctcgctctgtcgccaggctgaagtgcagtggtgtgatctcggctcactgcaacctctgcctcccaggttcaagtgattctcctgcctcagcctcccgagtggctgggattataggcacccaccaccacgcccagctaatttttgtatttttagtagagacggggtttcaccatgttggccaggacggtctccatctcctgacctcaggtgatccgcctgccttagcctctcaaagtgctgggactacaggcataagccaccgcacctggccaaaaattttttagaaaaccaacaatttaatacaacctcatgagtcaaaagtgatacatggagctaggcaccgtggtgcacacttgtagtcccagctgcttgggagcctgaggcaggaggatggcttgagtcaaggagttcgaggccaccctgaacaacatggcgagaccctatcaaataaaataaaagtgatatacaaattcatcattataactggtgtgtcatacttagttcactcttgaaacctgtcatctatttggtagactgagttttattctaagaggtattttaatttgataagatttattgttttcataatgtaaatgaaaggaaaatgtcaaattacttattttttggcaactgaagcaaatctgtcatgtttgagtaggaggaaaaatagcaaaaaagtaagtagctgactaaaattttcacaagacattagcagttaatctgggattagtatcccagcccagcttccctgagacaaacttttttttttttcctgttataaccaggaaactgcacataagtaaacagtacaactcccttaaatatcctttgacttgaatataaattgaaccaggttgcaaaagaaaagtatggaggaaggatcacagtgtgccaataacacgctgagatactaatactttaaaagtcactcctattcgtagcatgaataatgctgatgtgaagctaggtgtgaagtgcattctcagctcagaacaggaggcaggccctataaaatctcctcattccaggcctactgatggaaaccaaaggttttaaggtttagtctcctaattccacggaagttttcccaggggagatactcccagcagcatctgtaattctcagccttaagccactgactaggaggattcacacttaggagtgctaccacccagcattcaagactagtaacatgccaggcacagctaagtgccataccttcactgtctgaagcctcccaaatccataacgtccggcttggcaagttggaatagcttgctcgaggtcatgtggcaggcagccagtgtgcctcaagggcccctgcctgctctgatctctacagtgtccaaggcccagagcccctctcacttgaagggcagcaccttggggacaattggtttggggacactgttttgatggcgcttcctttgttgaaagaggaaacctctttttagtctattctcattaacagacgaatagccctgcgttattcctgttgcaagttgccttgccattgcttgctacttcagccgttcgaattcttttcgtaactttccatctcctcatgtaatgagcatttcatagcaacacatcttggatagaagtaaaatgtttttatactctaagcagatctcaaggttcccagcttggggaagagctggtaataaatgaagcttgcattgttagaggctgttagtccaaacggacaagatccctatggaggaaaattagatataccagtggcattggagtgttctgtgactgtctagcattatactatactaaggatgattatatattatattttatataatatattttatattttatataatgtatagtatataatacacttatatattataagtacatattataaggcctttttgctcttattacatgcttattaaatattctctgtcttgtactccaagattcaaatgaaatgtatagaaatgttgctagagcaagactggtggctgggcaaggtggctcaggcctgtaatcccagcactattggaggctgaggcaggaggattgcttgagcttggtggtttgagaccaggctgggcaacatggcaaaaccctgtttctaccaaaaataaaaaaacggctgggcgtggtggctcatgcctgtaatcccagcactttgggaggccgaggagggtggatcacttgaagccaggagttgaagaccagtctggccaacatggtgaaaccccatctctactaaaaatacaaaaattagccgagcgtggtggcgcaagcttgtaatctcagctactcaggaggctgaggcaggaggatcgcttaaacccgggaggcagaggttgcagtgagcccagattatgccacttccctccagcttgggtgacaaagtgagaccctgtctcaaaataaataaataaaaataaaaagactggtgacatttattaaaatgaaactcataattaggtagaagatttatttaaccacaagtaaatttatatcggaattcagtttataatttgagctttgttttttaaaaagcataaactatataccacgttctttctcttatagttgcttaagaaagaaaaaaaaaacttgaagcaacgctagttgaatgagggaagtagcgggagagtggcgggggatgtgtgctgttcccatcagcccatcaactctttttattctgcagtgggcaagatatggtgagcatcctccagttagttcagaatctcatgcatggagatgaagatgaggagccccagagccccaggtaatgaacctggcagcttctcttttcaagtgtatgtgttcttgatttcagtagtgattgcgctctgacaagttgctcaaataagaagctatatttcattgagttacatatgatattaaaataatcctttttattttcagaaagacatttatattaatatatattttgtgaaatgaaggcatttattgaaattagatcccatagtttttatggtatcatgccttagagaggcgctggcagaaggactgaagagtgagtgtcggatgtctttctgctgctgtgcttctgcttcctaagaattgctgtagttgtattcattaggtatttagttagttttctcttcaattattttaaatttaatgttttgaaataagtaaaattattctcttggttcaaaattcagacaatgaaaaatgatatacaaagggaattttccttcctacctctatctccctaccatgttttcttctctagagacagacattaccagtttcttgtgtattcttccagagagattttatatgtattatacaccagcaaaatgtctatgcccaccctctctaatacataattactatgcatatgctgtgcatcttgcattttttcacttatgtcttggagttcactgcatattaatgcacaggaactttctcctttgtcagagctatgtgttttactttgaacagatgaaccatattttattttattggtcccctgtcatgttgcactgttacaaacattgctgcagcaaacaactttcgacatgtgtcacttctcatagaagcaggtgtctggaggacaaagtcctgaaagtggagttgctgtctcagacagtgtgtgcttttgtaattttgatagatcctgccaaatttccctccatggagttgcggcatttagcagtcccaccagcaatgtatgagagtactttatttccacacttttcacctgcaaaggcgttatcagactgaaggatcattgataagtgatattctgatgagaaatctgataagtgagaaatggtgtttcagcataattcgaatttgcaggttttttaaattatgaaccaagtgacgtgtctttttgtatgttttaagacccatttatatttctaggaactgtctgttgcccatgatcctattaggtgatttgtctttttcttattattcacagttaacaattgtaaactttttccttcttttttacagttattctttataaggaaaattagttttaattctatataaaacattttatataatcaattttaattatatataaaataatacctagtcccccatgaatttgctgtattattgcaataaataattcttatttgatgcatagacctgagatttaattcttttttttttttttttttgagatggagtcttactctattgcccaggctggagtgcagtggtgccatttcggctcacttcaagctctgcctcccgggttcactccattctcctgcctcagcctcctgagtagctgggattacaggtgcccaccaccaggcccggctaattttttgtatttttagtagagatggggtttcaccatgttagccaggatggtctcaatctcctgacctcgtgatccgcccgccttggcctcccaaagtgctgggattacaggcatgagccactgcgcctggccaggatttagttctttaaaaaatgctttcagctcattttaccttagctctaccctccacaattcttaaggctggtatttaatttttaaaatactttaataggaaattattttaaaacagtttgtaggtactcaatttaaaaagggctatttatctcctggaactcaaattataaaaatatttttctggccaggagtagtggctcatgcctgtaatcccagcactttgggaggccgaggcaggtgaatcacctgaagtcaggagttcaagagcagcctggccaacatggtgaaaccccgtctctactaaaaatacaaaaaattagccgggcttggtggtgcgcgcctgtaattccagctactcgggaggctgagacaggagaatcacgtgaacccaggaggtggaggttgtagtgagctgagatcgcaccactgcaccccagcttgggcatcaagagggagactccatctcagaaaaaaaaatatatttttttctccatctcaaaaaatagaaaaaattctcaccaaactatcactactgtttatgcattgatttgccttctgggccattaagtagatttcgagtctgacagatatttctgtggaattctgtgtctctaagttctatgtccttttttatggtttgactctaatactttaattttgcttaacagaatccaaaatattggagaacaaggtcatatggctttgttgggacatagtctgggagcttatatttcaactctggacaaagagaagctgagaaaacttacaactaggatactttcagataccaccttatggctatgcagaattttcaggtaaagacatgatgagtttccagtgaagacttttatgagtcgggtgtagactgaaagatcttttttctggagctgtactacttgggttcagatttccttctccttgaaaggggtgtttaacctctcaatgcctgtttcatcatctgttagatggggatagtattaatacctatttcatagaagcgttgtgaggattaaatgagctaatggactaatacatgtgaagggtggagaatagaagcacatatgtgtttgatagggtcagcagttatttatttgtggggtatctaattggcacatgtcggtagaagatagagcaatgatctggattcaaatacagttgtcccttatccttgggtgtccttgggggattggttcttgacctcccatcctcaccctatggataaaaaaattcatggatgctcaaatcccttatataaaatagcacagtattttcatgtaactgaggcacatcttcccatatactttaatctcttgattacatataatacctaatacgatgtaaatgctgtgtaaatagttgttacactgtattgtttagggaataatgacaaggaaaaaaagtctgtagatattcagtacagaggcacccatctttttaaatttctgaagattttttactcatgcttggttgaatccacagatgcagaacccataggttcagagggccagctgtgctttgaaaatattagcttgtgtttttattagaaagaaaactctgaggccaggcacggtggctcacgcctgtaatcccagcactttgggaggctgaggtgggcggatcacaaggtgaggagatcgagaccattctggctaacatggtgaaaccctgtctctactaaaaatacaaaaaaattagccgggcgtggtagtgagcacctgtagtcccagctcctctggacgctgaggcactgcactccagcctgggcgacagagtgagactctgtctcaaaaaaaaaaaaaaaagaaaactctgtcataaggaagatgaaaatgtgctatgaaactgaaatttgttttattctgtgataatcctggcagtactaaggaattacaacaggtgaaggattcagtaggagacataggactagtggcattgggtttatgctgttacttttatggagaaggaatgtttgcctaacttgagacatttatcttgagagaccctgactttcagtgttgggaaagaacttggccaagcaggagtataagtttgcccaactttattaaaggagcagtgttctgttgttctagtaaaaatctactgcctgtaattgaaattgtccatcctcctctaggagatggagcctcagcagattatagtaaaaccaaaagctagcctgactagcttttttatttttttgagatggagtcttactctgtcacccaggctggagtgcagtggcacaatctcggctcactgcaccctccacctcctgggttcaagcgattctcctgcctcagtctcctgagtagctgggactacaggcactcaccaccacacctcgcaattagtagagacagttgtttcaccatgttagctaggctagtctcaaaactcctggtcaggtgatccacccgccttggcctcccaaagtgctgagattacaggcgtgagccaccacacccagcctctaactagcatttttgacagttttatttactttggatgttttagggctgaaactctgctatgaactatgcctgtgttatccagtgctggccttagttcataataagccagaaccatgatcttcaggctttttatatctgagaattcctggtctctacttgttttcatagtttctgctctttatggaattgggtatggatggagggttattgtctcgctgcttggtaacctcagctgtaatgaggtgtcagccatctatgatgaggatgtttcacattcctgtcctctctgcctgataaaagtgacaattcctagcttgagaaaagaattgtctccatgattataaggttgacttatacaatccttaactagaaataagagcatattaatatgtatctcttaacagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgctgagtgaaaagaaagatggtcttatatgcttttgtcatatttgtaaaaattactgaatttagaaataaggaatatgggatagattacccaggggcatccacagtcaacattttctcttttttcccagactttaatcgaagggggtgtgtttgtgtttatatggttgtatctggctcttttcacttattgttaaaacaggaatatatcattttaataataatttttcaaagtatagtttatttttaatgtcttcatggtattccttcaagtgaatatatagtaattaactgttgcccttttggacaactaagagtgtttgcattctcttgctttctgtgaccattttcaggtaatgttctttgtgtagtgctgttaaggacttctctgtgcataaagctcttcctgtattttatttagggttatggtcctcagatggattttcagagtcagtctagaattgctggatcaaagagcatgactttttttttttttttttttttttttttttttgagacagagtcttgctctgtcgcccaggccggagtgcagtggcgtgatctcggctcactgcaagctccgcctcccggattcatgccattctcctgcctcagcctcccaagtagctgggactacaggtgcccgccaccacgcccagataatttttttgtattttttttagtagagatggggtttcaccgtgttagccaggatggtgtcgatctcctggcctcgtgatctgcccacctcagcctcccaaagtgctgggattacaggtgtgagccactgcgcccagccgagcatgactatttttaaagttcatggtgcttctagcccaactgggaggactacatcgagataagacattgttaaccgtctttgccaagaacgtttgaaagcaaaaccatagggttggagggttcctcttttgtaagctgtaggagtcccagggggatgtatgggagacacttagtgacttttaaattgattctgagctgtgatcactggtgttaagaaattatgtcctcttcttgaggggtgtacaaaatggggagtttaataataatcctctgaaacgtgaaatgaattacttagtgtctactgcaagccaggctcttgcagacacaaggctgtttggggacaacagtctaaccttcaaaagatgtgtaagagtgttctgttgggaatggcagctggcagagcagcatatataagatggttatgttcacgttttttaaagtgtgtgtatcctttatacctatgtttttgtacctagaaaaatacgtaaatttatacctagaaaatatctgaaaggttatgtattaaactgttaacggggtggattggtggcttatagggtagggggctaggcattttcacttttaatacctgtattttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcacccttttttttttttcggcttggctttctaaatgtactttaacatcaatttataatattaagagttcctaaggagagagatttcttagaagaataatcgtgtcttgtcttagagccacagcctttcacaatctgaagtgaatggtgcagagagctttcttgtcaagtcatatgtttcttcctgcagctcggcttgcccttcccctgcttgtgccgtgtaccctgtaacactgtgtttggatcccagcatcagatggtgagttctacttttggtttgtaaaatcatgtgggattgtgttttgaaactgcctttcaaatgaagttctttttgctggcctccagataattagtaacttactcatgtattgcttggatccttacattgtgtaatatatgcttctgttaatatgtgaatgtccatgaaggttggttggtatataggtcaggagcacctggcttttaaggagtcttgtaattactgtatcacctgctttaagtagaaacatggcagctcaattaagcaccagaaatttcttctgaagctcctacttttaatgagttagcactgttgcctggatttatgaatgggcagattttgaaaatgaggttcttcattgtcatcatggaattgagttctgcttattttcagacatgcaggtgataaatctctccttaatgattccagaaggaaaaggaagggatggattttagagttttttatttcttttgtcaaggtagttttattttctagttcaggtacatcagtgagtaatagtagagatacattcttggctgttttaggagagttaagagaacatttcatttaaatgtaaatgtttaaaatcaaagaaatgttcctgcatatgtacagtttttacctttaattttgtttaactgatttttctagtcttcaaggaaaactatttgattttcacatctatgatgagagaaaacagaaaaattgtcaagagtaagaattgatttgacattacttttgagagttatctgcttcttttgtaagtcataatttttcattttatagcttttatactgggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacgtcctcagcctataaaagataaagtcttaagaaatgtgtgtgtaccacatgtttaagatagtccatatccacattgtagcaaaaactgtaatagtaaggttggctcgttagatttttctttaatcgttggtttgttttggaagttattttatgtgtgtgtatactttttcatttagatggtaaatgcttctctatcttctccttcatgtacttcttttccctgttctaaactgaattttattttatttttttgagatagagtctcactctgttgcccaggctggagtgcagtagcacaatctcacctcactgcaatctctgcctcccgggttcaagtgtttctcctgcctcaacctcctgaattgctgggattacaggtgcatgccaccacatctggctaatttcttgtatttttagtagagacagggtttcactatgttggccaggctggtctcgaactcctgacctcaggtgatccgcctgcctcagcctcccaaattgctgggattacaggcatgagccactgtgcctggcctgaatttttaaatgacacatttaagccaggtgtggtggcacatgcctatagtccctctactcaggagacaagcaagatgttggcttaagctcagaagttcaataccagtctgggtaacatagcaagaccccatctcaataaataaataaaaataattgtactgacgttgtaagattgttgtaaaaattaaacaagaaaattcataagatgtcacacttaaatatctaccttataggcggcagagcaactaccacttgctgctccatttatctcattcagcatcatacttgaaatctaagacagtgcaataaggcaaaaaaaataactgacagattagaaaggaagaaataaaactttgtttgcaggcatgattgtatagatagaaaactaaagaaaagctactggaactaatgatcaaatctaaaccattttctggatttttacatactagcaaagaagaattggaaattgaattttaaatgtcatttataataggatcaaaaaagatgaaaaatttatggataaatttaacaaaatatatgcaagatctgtacattgagaactaagaatgttactgagagaaattcaagaagacccaagaacgatatgccatacacacgggttggaagactaagtattaagtcagttcttcccaaactaatctgtagattcaacttgatccatcttaaaatctcagcaggctacaatttcttaatagaacttgatgagctaattctaaagtttatatagaaatacaagggatctaggaacagcccaagggattttgaaaaagaacaaaattggaagacttaccttgtcatacttcaagacttctgtaaagtagcaagtaagactgtgtgagattaaccaaagaaaatagagaattcagaaatagactcatgtgaagtatatggacacttcaggtttttacagatgcctgagtaattcgagggagaaaggaccatctttttccatcagtggtcttagagcttggatatccatatggaaaaaaactgaatcttaacccttatcttattctctgtatatataaatattaactataaatggttcatcaacctaagcatagatctaagacaataaaatgtctcaaagaaaatacaggagatctttgtgaccttaggttacatttcttaggatacaaaatatgtgaaccataaattgtactttatcaaaaattaaaagcattagctgtttgaaagcccctattaagaagatgaaaggcaagttacagactgggagaaatatttgcaaaacatttttttctttttttttttttttttttgtctttttctatttttattttttatgtttttgagatggagttttgctgtgctgcccaggctggagtgcagtggtgcgaccttggctcactgcaacctccgcctcccaggttcaagcgattcgcctgcctcagcctcccgagtagctgggattacaggcgcacgccaccgtgccgggctaatttttgtatttttagtagagacgagatttcgccatgttggccaggctggtctcaaactcctgacctcaggtggtccacctgccttggcctcccaaagtgatgggattacaggcgtgagccgccacactcagccagccactgtcccagtcctgtcttcttttaaaatttctttttcattcttttccccagaagctacaaaacatttgtttgacaaagaacttgtatctaaaatatataaagaactgttacaactcaataaggacacaagcaatacaattttttttttttttggagatggagtctcattctgttgcccagactagagtgcagtggtgcgatcttggctcactgcaacctctgcctcccgggttccagtgattcttctgccttagcctcccgagtacctgggattacaggcatgtgccaccacacctagctagttttttgtatttttagtggagatggagtttcaccgtgttggccaggctggtcttgaactcctgaccttaggtgatctgcctgccttggcctcccaaagtgctgggattacaggtgtgagccactgtgcccggcccacaatacaattttttaaatgaacaacagatttgagcagatacttcatcaaagaaaatgaaaatgtatagcacttgaaaagatgtttaacatcattagtcattagtgaaatgcaaattaagatcaccatgagacattactacatgtctgttagaatggagaaattacaggtggctcacacttgtaatcccaacacttgggaaggctgagactgcgagatcaattgccctcaggtgttcgagaccagcctgggcaacatggcgaaacccctaggaaatctctacaaaaaatactaaacattagccaggtgtggtggtgtgtacctgtagtcccagctactccagaggctttggtgggaggttggcttgaacccaggagagagaggttgcagtgagccaagattgtgctaccataccccagcctgggtgacagagccagatcctttcttaaaaaaaaaaaaaaaaaattctttaaaatataatgtcaggccaggcacagtgactcaagcctgtaatcccagcactttgggaggccgaggcgggcagattacgaggtcaggagatcaagacatcctggctaacatggtgaaaccccgtttccactaaaaatacaaaaaaatagctgggtgtggtggtgggcacctgtagtcctagctacttgggaggccgaggcaggagaatggcatgaactcgggaggcagaggttgcagtgaggtgagatcgcaccactgcactccagccttggtgacagagtgagactctgtttctgtaaaaaataaataagtaaataaataaaacttgccaggtgtggtggtgggcacctgtagtcccagctacttgagaggctgaggcaggagaatggcttgaacccgggaggcggagcttgcaatgagccgagattgtgctactgcacttcagcctgggcgacagagtgagaccctatctcaaaaaaaaaagaaaaaaaaaaaaaaaggcaaaaaactacagtgacagaagcagatcaggattttccagggccagtgaggagtcagggaaagggtaattatattggggttgatgggatttgggggttgatggaagtattctgaatcttgattgtgttgatggttacatgctctatatatttgtcaaaactcattggaccgtatacttacatgagtgagttttgttgcatgtaaatcatactacaataggccgagcatgagagctcatgcctgtagtcccagcactttgggaggctgaggcaggcagatcacaaggtcaggagttcaagaccagcctgaccaatgtggtaaaaccccatctctactaaaaatgcaaaaattagccaggtgtggtggtgtgcacctgtagtcccagctacttgggaggctgaggcaggaaaatcgcttgaacctgggaggtggaggttgcagtgagccaagatcgcaccaccgcactgtagcctgggcgacagaaagggtctctgtctcaaaaaaaaaaaaaaaaaaaaaaatcatactacaataaaactgcttatttaggccgggtgcggtggctcatgcatgtaattccagcactttgagaggccaaggcgggaagatcacctgaggtcaggagttcaagaccagcctggccaaaatggcgaaaccctgtctctactaaaaatataaaaattagctggttgtggtggcaggcacctgtaatcccagctacttaggaggccgaggcaggagaatagcttgaacccaggaggctgagattgcagtgagccgagattgcgctgctgcactccggcctgggcaacagggtgagactctgtctcaaaaaaaaaaaaaaaagacaaaatagaaaaaccacataaatattcactttattgccaacaggaaaaccatcacttcctgccttattgtttaaaaacacaaattcacccatattcaatcacatgataaactggaggggctgcagtttgcatgtgactgagtgacttgccagtgtgattatgttgcagatgtcagcagacacatgtcaagggttagtcaccagacattgccaagaaatacgaaaagagaatctgcatgcgatccaggcactaacacagcagtacgcttttattttgctggaagagcctgtggcacagcccatgcattgacatttgatcttgtttcagctaaactaaatgtgtctgttaagattttttttttttaatttgaggtagatttaggtatgaggggaaaaagttttcagcccttttcctggcatagaccttacaaaagaactactttctttagctgtgtttgttgaggccgttggtgagtgtttgaaatctttttagttggcttactgctaactggaaatttaggacggttgggggaatgcctgactcaacgttttaactaagctctctctgaaaagggatctccccagcaaaatctgtagtgcaatcaattaccaagggagcggctgaaagtgcttaatatgcttaagctggcttcagaatgcatgttctgtattacaaggaacctgggtggaaacaaaacaaattcatctatatgttttgtttgtttgttttttgagctggagtcttgctttgttgcccaggctggagtgcagtggcacgatctcggctcactacaagctctgcctcccaggttcacgccattctcccgcctcggccccgcgagtacctgggactataggcgcccaccactacacccggctaattttgtttttgtatttttagtagagacgggatttcaccgtgttagccaggatggtctccatctcctgaccttgtgatccacccgcctgggcctcccagagtgctgggattacagatgtgagccactgtgcccagcccacctatatgatttttataaagggcatatctaaatcaaaataatccaggaagtgacaataaaataaaaaggtggaaaagtttatcttggacaaatgctgacaaaatgaaagtaccatagccatattagtgtgggataaaatagacttcatattgatgaaagatgtaatctcctaaaagaaataacagttatacctgctgggcacggtggctcatgcttataatcccagcactttggaaggccgaggcaggtggatcacgaggtcaggagttcgagaccagcctggccaacgtagtgaaaccccgtctctactaaaaatacaaaaaaattagccgggcgtggtggccaccgcctgtaatcccacctacttgggaggctgaggcaaggagaattgcttgaacctgggaggtggaggttgcagagttgagatcatgccactgcactctagcctgggcgacagtgtgagactccgtctcaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattgaaagaactctgtgagcagtatggcatatggcttcatgtggaggggtaagccggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaagaatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaagtcactcagtccctcatggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttggtaagtttccactcactggggagggagtgggtgtggctaatacacattattggctttgggggcaaaatccagaaaaatacaggaaaaagtgaaaaatacccataatttcacttctatttcatttttttaaagagaaacttgtgagactttttttaatgacattttatgattgtataatattctgtcacaatttaattattctccatttatgaacttataggatgttttcagagttttgttactgaaataatgaagcagtgaacgtctttctgtgtttctaattatttccttagaataggttcccagatgtggaatgactgagtgggggagttttaagcctcctgatccacattgcccaataggttttaactttttttttttttttttgatatggagtctcgctctgtcacccaggctggagtgcaatggtgagatgatcttggctcactgcaacctccacctcctgggttcaagtgattctcttgcctcagcctcccaagtagctgggattacaggcatgcgccaccacgcccggcttattttgtatttttagtagaggcagtgtttcaccaagttggtcatgttgaactcgcgatctcaggtgatctgcctgcctcggcctcccaaagtgctgggattacaggcatgagccatcacacctggccacatttttttttttttttaatcgtagttgtgggccaggcatggtggctcatgcctgtaatcccagcactttggaaggttgaggcaggcagatcgcttgagcctaggagtttgagaccagcctgggcaacatggtgaaacctcatctctataagaaaaaacaacaacaaagaattagctgggcatggtggtgtgagcctgtagtcccagctactcatgaggctaatgtgggagggctgattgagccctggagatcaaggctgcagtgagctatgatcacaccactgcactgcagcctgggcgacagaatgaaaacgaaacctgtcacaaaaaataataataataatgtggttcttgataatataggtcagcgtgcaaaataaggtttaagtgatttctgctaaaacactgctgtcttgctcagctaataatggccaggtgtttgaggatgctcagagctaccttcgaagtggggagtctcctaggttctgggatgtgacccatctgggttttccactggcttttcctggctttgccactcctgagctgtgaacccttggacaaaccgaggtctctgagtgaagttacctagaatacttagctcacagagttgttggaagatcacatggataatgcaagcctagtgactagtatggcatctagcccacactaagtgggtagcaaatggtagctggttagttctattatgagattgcaatggctttgattaataaacctcttttggcttttttagactttagttgctggtcttacatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatccagagtggtgttgtctggattgactgtctcgtgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagggtgcaaaaggtggaggggtggggagcgagtgttccccttgattgactgactacggtgagggaataggaaggttacaaggtggttatggagggcatggatattttataaaccagctggcttgggtttccaaattgcagggctcttggggacaattctaattctctctccattttaggtgtgttctaattgtgaaaaatatataattatgctatatttcagtgttttagagcattcaggcttctataacaaaataccttagagtgggtaatttataaacaacagacatttattgcttacagttctggacgtgagaagtctcagatcaaggtgccaggagattccatgtcgggcccgttcctcatagatagtgccttgcatgtggcctcacatggcagaaggggtgagcacagtcccttgagcctctttcagaaggtcactagtcctgtttgtgagggttccatcctcatgccctaatgacctcccaaaggcctcaactcatttgcgattaggtttccacataggaattttgtggggacataaatattcagatcatagcatttagaaagcaaaaaaacaggctgggcatggtggctcacgcctgtaattccagcactttgggaggctgaagcgggtggatcacaaggtcatgagatcaagaccatcctggctaacacggtgaaaccccgtctctactaaaaatacaaaaaattagctgggcgtggtggcgggcgcctgtagtcccagctgctcaggaggctgaggccggagaatggtgtgaacccgggaggcagagcttgcagtgagccgagatcgcgccactgcactccagcctgggtgacagagcgaggctccgtctcaaaaaaaaaaaaaaaaaaaaaaaaaaaagccaaaaaacagggtcatgtttactcagggttagagctgagccctccctaagctcagaagtgcgtcacctccattttcttacctgtgaaatataaattatatgacaaggattgccaggatggctcgaggaacgaatacaggtagagctcttgcagtagtgtctgttcatatagtaagttatgcacgtgggttgaaatctttgttttaaatatattcttggggagttagcacttcctcaagtatcatttctatatttaagaaacataggtggccgggtgcagtggctcacgcctgtaatcccagcactttgggaggccgaggtgggcagatcatgaggtcaggagatcaagaccatcctggctaacacggtgaaaccctgtctctaataaaaatacaaaaattagccaggcatggtggcgggtgcctgtagtcccagctacttgggaggctgaggcaggagaatggcgtgaacccagaaggcggagcttgcagtgagccgagattgcgccactgcactccagccagagcgaaactcagtcttttaaaaaaagaaagaaaaataggccgggcgtggtggctcatgcctgtaatcccagcactttgggaggccgaggcgggtggatcacctgaggtcaggagtttgagaccggcctggccaacatggtgagactccgtctctattaaatatacaaaaattagccaggtatggtggcaggcgcctgtagtcccagctactcaggaggctgaggcagggagaattgcttgaacttgggaggcagaggttgcagtaagccaagatcgtgccactgcactccagcctgggtggcaccatctaaacacacacacacacacacacacacacacacacacacgaaaagtatttgcgtagtgctctagcagtagtcccttcgttcatcatatgttaggatagttcaacagttttaagtatgctctgggctgggtgcagtggctcatgcctataatcccagcactttgggaggccaaggcaggtggatcacttaaacctcagagttcaacaccagcctgggcaatgtggtcaaaccctgtctctacaaaaaatacaaaaattagccaggtgtagtggcacacacctgtgatcccagctactcaggaggctgaggtgggaagatcacttgagcccaggaggtcaaggttgccgtgagcccaaatagcactactgcactactccactccagcctgggcgacagagtaggaccctgtctcaaaaaaaaaaaagaaaaaaagattgatgctcattatgtttacaaaagcactgcattttttgaaaagtgtctcactgtgctattagctcacttcttgagatgtggttcttaggaaagagaagccttagtaacttagtttagagacgacttgggcactcgggagattttttcaatatcccgtggctatggagtgcgggagaatgatgccattaactaccagacccttgaggtcagcacagctctggcatcttcctgcaggcagaaccgtatactcctgaggatttgaatgctgtcctgctgctgactcacaggctaataaatgcatgtgttaaattacttggacatttagcagacatggtgatctgtatatagccatgccttatagtccacagtggagcatacatttcctgagagcgtaaatcagcattcgcctcctcatcctcctcttccttctcttctccctctcttctttctcgtcttcagtagttattgagcattcacctcagtgtcaggcaccatgaagtactttcatgcatcatctcatttgatccctgcaacttcactagaatgtcagttccactgatgacagtgtattcagaattaattttctttaagaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgtttctaagcacttcctgtattgcatatcaactcatttaatcctcacagcaatgtgagatacatactatcctccccattttataattgagggaactgaagcatagacaggttacatagctggtgactggcagatgaattgacttatccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctccacagcccctggtgaaaaccacttcttcatgtcccacgtccatctaattacatgtgttattttttgtcatttgcagagtcaacggttgcaggaaagtttgaagaaagtgaattacatcaaaatcttggtatagtatataagttcatctgttttcaaaatataactttttttgaacctcagcaactttgaatgattttagaactttagaatgattttctccacatttcagtggaattgtggcagctccagtaaaaaaacaaaacaaaaaaacgaaacaaaaaacaaaaacaaaaaaacctgcttatatttatacagtgagtctgaagcgaagaaatttgaaccatacaatgtttaattcctatggtgcttttcatgtacttcatttattgtgttaaagttcagaattgcacaaagataaacaccattgacttcagctgcccaaggccttgggcacactcttcttcccaaaatgaaaagtcactttgtgcctcagaatgctttggggttctctttctgcaaccttctgccatcagttttcatttgcatgaagtgggagaaagagaaaagcaaatggccctgctcttgtcttctgatatcttcctgaagtgaatccaacagattgttccctaggcataactagacaaggaaataaggacttaggagagaatggggatcagttcaggtttgaaagtttttgtgttttgcttcatggtattttagaacttcaggaaatatatgtcaaattctgatttaaataggttcattgagtgtttctttgacaattctgcaaggtatgcttaagtttaacatttgagtgtatttggggttcaagtcagtaggtttatttttcttttagaacatggtttggtttaaatacaaaaagtagccgcgcatggtggcacacgcctgtagtcccagctactggggaggctgaagtgaaagaattgcttgaacccgggaggcggaggttgcagtgagccgagattgcgcctctgcactccagcctgggtgacagagaccctgtctcaaggaagaaaaaaaaatgcatggtttggttgaagggggtgtggctactctgccttctgagtgggagtctggagccagttgacccgagttctagctcagtgggagttctatccttggacgaggaagtggaccactggagaagcagaagggatgaatctaagttcagaggcctgggctctgctctgagcagtgccacagggtggccctgtgacattgagtcattttctttccaagcttgactgtcaaatgaaagtatgccggttggtctcctctgattgcaaacagagaagcaaattatggcctagattgagcaagctgttaagaatccaggcggtgctgggcccatctgctttcctgcccctgccatgttgagcgcacttggcttttcctcagtcatcgctgctcccttattctcaaattgggggacccagtggtgctagttaatcaccagttgttttggagcatctctgtaggccacactggcccaggcagaaagcctgctctgtcccttcttccaatggctgttttttcagtagaggatacaataattggctaataccatgaggcattatggcctgtgagtcctcatcatcaccatcaccatcaccaccattccagctgctgcttgtgaaattcatgtgtggtactaagtaccttacatgaattatttcatttaaccctcccaacagtctcctttgtatgtgctgttctctctgcctggaaacactgtttcccaccccccgtccccaattcttctgtttatttttttttgagacagagtctcactatgtagcccagactggagtgcagtggtgcgatcttggctcactctaacctccgcctcctgggtccctgttcaagcagttctcctgcctcagcctcccgagtagctggggttacaggcgcatgccaccatgtccagctaatttctgtatttttagtagagatggggtttcaccatgttggccaggctggtcttgaactcttgacctcgtgatccacccgcctcagcctcccaaagtgctgggattacaggcatgagccaaagcgcccagcctccccagtcccaattcttctcatgactggtttcttatctttcagatcttaattcaaatctcacctcttcagaaaggcctttcctggccaccctaagatcatctcccaccgtcagacatcactccatccccctgggtcgtcttcatcactcttactactatctgaaatcaaatctgtttgttttttcctatagaaggtttgtaaaggccttatacagactcaccactgtgcctcacctgggcattaacacccaagaccctagccctgaaagcccagtgccaggccccagacatgctcccatcccctgccactcagcttacagtcctctttctgtttcctcttctttgtggattcacctttttttgggtgtgagcccagccatggtttaacctttttttggttcttggttatatttaatccagtatttcagatattcagaattgacaacttcagtgttcactcagtctatcacgttactagaaccagaagtgtctccaaccctgtatactatttcttacacacattgacatttgagaccactgagttcaaagaaagaaaagatgatcataatattcatagcagtcttggcactcacctcattctgccatctcctagctgaggatgggagaatgggcggattattttgttgcctttttgttcctccttgcttattgggcgtgcgcccctatttaaatattaagcaccgcccccctgccgcccgccgccgtacctttaaaagtatcacgttttatttgtctctgtgaaagttaaagatgatagatgtgaaggcacttagcacaggactggccccctaaataattggcagatttgaattcacatcctgcttggtatgaatactgtccacacggtcctttgaaaagttagtagaaaagatcttgggccactgcttcttgtctttccaagttagcatttcctgttgcggccctaccagtgagtcatcacactcagagccttggaacataagttttattactagagctatagtactgggattgttggatgcttagagatcttccccctccagggccacccacactcccctacagtaccacagagcctgccaaggacatggatgcttacggtaccctgaccccatggcttgaccaagtcagggtatactgtttgatgcaaaacaggaactcgctgctggattatcataatacataatgcagtggatgttttcaactgttaggaaacccactaatgaagttagtcgtcttcggcctgtctttaataataattaaatatattagaaaatacacagatccagttctcagctgtgcttgtctacatcaccagcaggacttgcatcttgttctgaaagttttgcaaaggggaggaaagtacttgttgccccctctttttttctatgagtatgaaaaattctagttggccaggcacggtgtctcacgtctgtaatcccaacacttggaaagccaaagtaggaggattaattgaggccaagagttcaaggccagcctggacaacatagcaagaccccatctctaaaaaaaccgtttaagtttcaataaatcctgcataatttctgggattcttgaaagcatgggctctctccgcactgagtctagtttcactgcttcttactggttttaatctttaatgttagacctatgtttatcccttattaaaatttccccctgctttaatttcaatgtaccagggtcaaacatcttataattcacagtgtactctcaaggctggctcatagttattttttaaaattttactaaacatttgatttttctctagcaactgaaattaacctctgaactttttagtgtgtttatttacaaatagagcatttctaagcgagtttttgaactcagcatttcattttgaaggcgtctggagtttaatgttacttggtgatatgagacttccattcttccaggtggaagatgagctcagctccccagtggtggtgttcagatttttccaggaattaccaggctcaggtcggtgaattttaaaagagggttattttcatatctgtgttaaaggctttgaatttgataccatttcaagttaaatagttcaaaatatttttattgctgacaatcttcagtcagcatttcagaaaaatgtaataattttcatgaaaactacagtccgaaacgccttagcaatttgctgatagtttgcggtgattaaaccaggggttcccaaatgccagtccctggaccagtgctggaatggctaagaaagagttgcttgaacataaagatttgtgggtcttacttcccacatattttgagtcaataggttgtgcccaggaatctgtatcttaaagaatgacccaagtgccaccagtctagtccagggcaccactctttttttacctggttggccattgtcccctgtcaactgacctctgactttcatacattctacacagcccattccagaccattctccacctggcagagagggttataagtggaagtcacatggtgttgaaaccggaaaggttcccttgtccccctcgcagggcatgtgatgggggtgtggctcgcttcttcagtgccccgctgctgctcagacctctaggagagcatacagacgggcaggctgtggggctccgaccccatggcagcatctgggggtgaatgttttacagctcctaaggctccagcgggcatgtgttacagtgtgctcttttaatttagccgtctgtaggcagcttgttttagctcacttagacccccttccttatcacaaggacagagggattaatgtatcccaggttcttgtcttggtgtaccggaagaatgggatcacatgtgggcttggagaatgagtgcaaggttttattgaatgaaagtagctctccgctgatgggggagccagaagggagacagatttcccttggagttgggccgctcagcggccctggccaaactccgcctcgtccccgtggttgatggcctgctggcttgccggggcctgtcggggtgctcttctgccggcctgctctccatgaccagccgcttgtgtctttttccaccaatgtgttcctctggccatccagccacttctgtctgcccactagggtctcaggtttttataggcccaggatggtggtgtggtgggccagcgtggtcttgggaaatgcaacatttgggggaaggcaggagtgcttgtcctcacctaggtccgtgggggtagagtcctagccagggacccgcctttctctccccagcacttcccttccccgcttctgtgtcatttaaagggaccacgctcttcccttcccagcactcccgtatcagtgtcacttccctgcccagagcccctgggtatcttaccatttcggtcgaacaaaggccaggctctcccatgccccatgaggcctgcacactctgccccgaattcgcttctgccttccccccttccactctccctcttgttcgttgtgcctcagtcagaccagtcttctccgcgctccagaacactctgccctttcctaccgcaagggcttaacactcggcgttccctctgtcttacacacatttctctcttctggtgccagctcctcctcaccatttcggtctccactaagtatccacatcctcagccttccctgcctatcgtgcctgaggggactccatcattttctatcagagcccccagcttcacttgtgacactaacaaccacatggagtgattttctttctttatggtctgtttcctcaactaaaatgtaagctccaagatgacagaaaccttacctgccttctgtcccaagtgtcgggctctgtgcctggcacgggttggcacccactgtgaggcctagttagatgatcgtggcactcacagacctcgcacggtgcttggtaaactagttagtaacttaaaacaattgctgtttccccttgaaatcccttgaaagcaaaccttttcaaaaatgaaattaataattctgtcttatgtgaatgtattcaagtgttacatagatcacgaggaaaaagaaatgtagcccttctgtcagataatacatgagaattcagtaatacgagtcagtgccctggggctaatattgggatgggaatgatgtggggtttggagggtgttttttttggtcagccgtgtttctgggagtgactccctttctgtgttttggtgtcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcagttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttcattgtgtcctcctcacagctgggagaacagctgaagcagctggtgcctgcaagcggcctcacagtcatggatctggaagctgagggcacgtgtttgcggttcagccctttgatgaccgcagcaggtaaaccaggcttggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcaccttgggaggccaaggcaggcagatcatctgaggtcaggagttcgagaccagcctggccaacatagtgaaatcccgcccctactaagaatacaaaaaattagccaggcatggtggtacacacctgcagtcccagctacttgggaggctgaggcaggagaatcacttgaacctgggaggccgaggttgcagtgagctgagattacaccactgcactccagcctgggggacagaggagactccatctcaaaaaaaaaaaaaaaaaaaaaaaaagtcatcacatgaattccttttttgttgttgttgagacagggtcttgctctgtcacccaggctggagtgcagtggtgcgatcatggctcactgcagccttgacctcctgggctcaagtgatcttcccacctcagcccccgaggagttgggaccacaggcatgagccaccacactggactaatttttgcattttttgtagaaatggggttttgccacgttggccaggctggaattcctatattttgatgtcttgtgactctcgattttccactacaagggttctcactccccactgcacattagagtcatccgggagctttacacacaaccagtggccgcccacccccagagattctagaatggagcctggggatctgtgttttggtttttattttttttttagaaacagggtctcatttgtcaccctggctggaatgcagtgtcttcaccatagctcattgcaacctcgacctcctgggctcaagcaatcccctgcctcagcctcccaaggagctgggactacaggcgagcaccaccacatctatttttttttttttttttttttttccatagagacgtggtctcactctgtcacccaggctgctcttgaactcctggccttaagtgatcctcctggctcagattcccaaagcactggccactataaggattgcctggccacagctctagatacttagtctctaaaactgcaaaagtaagccagtgagccctgaggcccggcgctgtcaccatctccctgtccttcctgtgtggggacagcagcccaccacagtacttccctttctctcagtcataggaatgtacagaatctgtggttgcctttttgtgctgaacctatggtgtgatgtctccagcctgcctgaagtaggcttgctgtgggaagagtgatttctaacactggagtatgtcattgtgggccacatctgtgagagaaacactccacacctgctacagccagctgtgtctgtttctaaccctaattcttccatatctgtgttgagggcctttttttgtttaaatctccatggctcccggtaactggagtacctcgagcttttgaccttcccagtagtggaagagggagccctgccctcttgtcattggccatctcgtgagcatttctctgacattgtgaacatcttcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatatgcttaacgaaaatgcaactcggttttctgggcatttacaaaagcacagtgcaagcaggcaatttggccagcgtggcgctcagggaggggagttgctgaatgttctgtctgtaggtgccgactctcagctacctaggagaagatgccaacaggtatatatcactcactgagaatggttactatccagggcatatagagaattgcaaatcagtaagaaaaagaacccagctctcggggagagaactgggtgcagtcctatggctgctttctcgccttcagaggtgaggcaaacctctttttgtattgcccatgagacttccagaccttgtatggaactaaagacttaggctttcagctgggcacggtggctcatgcctgtaatcccagcactttgggaggccaacaggagcatagatgacttgaggccaggagcttgagtccagcctggacaacatggcgaaaccccatctctagaaaaaatacaaaaattagccagaggtggtggtgcacacctgtagtcccagctactcgggaagcttagatggaaggatcaactgagcccaggaggtggaggttgcagtgagccaagatcatgccactgcaccccagcctgggccaccaagtgagaccctgctttaaaaaaaaaaaaaaaaggctttcctgtgactttctctttactcctggcacacttccagaaagtttgtggtctggagacactcgcagtagctcttttgcccactggttccactgcattgtcttgctaatatttagaggtttctaatcctgtatcagaagagacatttgatcttttaagctgaaatgctgtggtttgatgttgttttaggtatgaacatgctaatgatgataagagcagtttgaaatcagatcccgaaggggaaaacatccatgctggactcctgaagaagttaaatgaactggaatctgacctaacctttaaaataggtaactgcttactttgtaagtcagctgtggggtttggaaggacacttggtaaccggctttgaagacgacggctcatcccttagcgggctagcgcctctcgggctgggttccaggcgaagatgcggttctgagacctccctccccttctgcagccttgccaggcctttctctccgcccttagaatctccatggaggagacccctttgtgtgtggtcaggaccctgaacaggagagtaggtccacgtctcacccatgacagaggactgagaaactcaagtttgtctcgttacctttgcaggccctgagtataagagcatgaagagctgcctttatgtcggcatggcgagcgacaacgtcgatgctgctgagctcgtggagaccattgcggccacagcccgggagatagaggagaactcgagggtccgtagcacccatcagtgttcattcctcttctgagttttgtcccaccaaacagcaggggccacgaggaaagcagctgcccttgggatgtctgttcgttgtctctcaaagtctgtcaatgtttcctgtaagctgggccttgtgccaggtgtcagagatgccaagtaggtttgacacagcccatgccccagtgatctcacaagctcagggggaaagatccacatagccacgctgtgtagtaaccctgccttagagaagagggcgggtagctggacactcaggcagacacattcacccctgccaccaaggtcagggaggacttctgctctggagctgtgtcctgagggtgaatgaaatgggctgttgtatgtgtggttccccctacaccccttccctatagcacttcccaccaggaatagacctactgctgtgggtcccttagcatggaggaccaggatacaaggctgataaggtatcctccaaacagatgattacttccctaaaaatcactcaaaaggagagaagagggaccaaggtaagactgctctgaaaggagagagacacgagccattggacatgcggccgagaagccagcttcattcctttctgggtggactccttaaggtttctttccagcctgactttatgacttctctgttttcaagaatacgtagcaaatgaggctggtcaccaaggtgtgtctgcctaggcctctatgagcatgttatctgcttgtctttgagtttctgttcgttttacgccggcttttcaatgcaggatttcattgacctgcttttgaaaaattccctcagtgctgtgttactagctcttctgggccccaggtgagaaccttaaacaagtaatgtctttcttggtcttgccacagcttctggaaaacatgacagaagtggttcggaaaggcattcaggaagctcaagtggagctgcagaaggcaagtgaagaacggcttctggaagaggtgaggcccccgatgggcagcaggctgggggagccgccgtgaggccaggtggccctgaactctggtcctgtcttgcagggggtgttgcggcagatccctgtagtgggctccgtgctgaattggttttctccggtccaggctttacagaagggaagaacttttaacttgacagcaggtaggacggcatagcctcttcccaggtcttgctgaccttgggaggtttcaccaaatgcccttgggtcccaacacttcccactgagaatcccgccctggttcccgttcttcatcactgggtgtgggccggacatctgaggagacaagttctggtgtgccctgtcctcctccccaccgcaccctggcggctgaaacagcaaggaagcagctacccactctccacagctgtcaccaccgcaaggccatgaggacacgcccactcagccgtgcagactctcagggtgctgtgtcttgggcattttggttcagggttaatacttcttgtcttcatgtgtgttctgccccagcagaggacagcttttgcaagtggcaatgcagagactgaagcatggagtgctggcacggtttattttgaaccaggcagccagcaagcgtttcagccgctggaatgtggggagggtgttaacagtccgtgactcctttcctgttctaccaaggaaataatttcctacactcgagccccttccttcattctttcccaggaaacgatgactccattgtcatgaaagcaaaagataatctgatttctaatctgccaagccttagccttcagcaaaaaggcacccacttcttgtggctacagtacgtttccctgttgggcctggctccctgggtgtgcttacgccatactgctggcggatgctggcggtactggccctgtgaggtggctttctctagctcacggcacattcataagtgcccttctctccaccagtctgtggcaggctcagtggctggaaggaggttattggggagcaaggctgtgtgagggcaggtggtgtcttcaagggcagcctgtgcctgtagcttctacccagccctctcctctcccgcaggctctctggagtccacagaacccatatatgtctacaaagcacaaggtgcaggagtcacgctgcctccaacgccctcgggcagtcgcaccaagcagaggcttccaggtaagtgacgcctctgcaccgagttcaggtaacaggtttcccctgttgactgttacttgcgtttgttttctgggttcttgaactccagaggtctatttctcttaagaccaactactaccatctctttaaccatcttggtagccgtgggattcagccttgaagaaatcccacggtagtgcgctaaggggaagttggggtcttgaaagatgacattgtcactgtggtgtttaccctcctgggcgtttcctaatgaagatgaccttagagttccccggcctggggagcatgttggtgtcaagctagcagctctcggttttctcatctcctaaaacacctcagagccagtaaaggtttctgctgaagctgtgttgtgaaataaagcaattatctgttgcagagacagcctgtgttgcagaagtatcctcactgagtttcagcgcagtctgtctgccctttctgtaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgttaagaaatgaggtggcctgaattagtaagaaaaaagttgattgcttactgctttacccacacacatttccatctaggacttgacatatccccatttgatatacaagttaaatggggtctgtcaatggcatccaaaaagttactacccgccaaagggaaagcagctatgacctggtctaaaccctttttttcttacagatggggaaaccagggtgcagagatttaagacttacccagcctgtaaactctcacctctagtatttgcttgtcatcttggtgcaaccagaaatccacatgtggaaatggtgtccaggagtacggtcctatacgaagttgttctgtctctgcatcataaatgctaatcatctaaaaaagaacgtgtcaaggatagaatttcaggaatgtcacccacttttcaaaccctcccagtaacgcaagctccagtgtagtcctttcatgcatttatctgcctaagcttcttaaaacctgtctcaaataacaaaagctgccagctactgaacacgtccagtgtgtctgcttctgcacactgtggggcacgcacgactgctgagcgccaacagcagtcccacaggacgagggtgttttttcccatttggggtgaaaacttgaggctcagagaaacaaggcccatttcccaggttacgtgtccagtaagcctcagagctggacctcaaacccaggcgcttctgactaaagtctgtgttcccattgcctcattatttataccccaaacaactgatcaccttgcaatttaaaagcatacagtgcctgctgccccatcaaaagaagaagctaatttgccaaatgatccagtccctgaattcccaaatttgccaatggcagcctcagcttacctagcaatattcactttggtaactgacactgaaatatgttctgaatatcaactaaactaggcctgttacactccttgagaagtcctaaaaatgttaaaagggttggctccgaatccaaacacatttcccagtgaaaacatcagcatttcataaatgagaagatttctttggggtggcctgaatgtgatttccgttttttcacactttgagcatttttaaagaattctttcacccattcctcaaatggcatataaaccttgggttttcagttttctaacttttaaaattacagtgtaatttaattaagcaccctaagggaatcagactttaaattaatttgatcattattttgggttaattaaattgttccagcaaattgctcttcagtgacccggtccaaaagaatgcatagtcctgagtgcagaggggagaaacctctctcctgcgtcccagttctcctctctttgtagaactttatagaaaagctcttacaaagtaacagaagtttgttctctttgaattcggatgctggggttcacacttacctcccacaccttttaggcagagaactggagctgatgacctaaagatgttcattactattttgagacagcaagtgtggggaggggtatatgtatgtgctggtccctgataatgtacggctataaagaagctgacagcataaacttttctaagatcccaaaaacttaaggccttgacatttgatgcctttttttttttaaccccttaacaaagatgatttgaaactcactggtcctcctgctaaagttcgcgcagcacgaagctgctcctccggaccccgatcttgaaaggatgctctgtaaatctctgcagtcttaatgttgacagctgtgagggacaacaggatgactctgaattgacaaaagaccaaagcggaaagtctgcacagtcttacatttctaccaccactcctaagagaaagataggaaagtgaacagaatggctcctaagtatctggacttccccctccctggagggggaaaatgcaacctttaccccaagcatctcggtgaaaatcgctgaggctcgagctggactcggtgagattttgttctaaaccaagagctgctttccacatgggaggcagccattccttcagtcggacatgtagcaaaacctctggtcatccctactggtgtacggccaggggtggctgggtgaactgtgatcgttctgtttgaatcttcacaatttagtattttatacatacacgaagttacagagaatagaacagtgaacactgtgtacctaccacccagctaaatcaatcaagtatcaccgctacagcagaagccctcggaaatagagccgattccatgatgccttttccgcgggagtcctggggctgccaagcagggaggatggttctaggttttctctagcctaagagttttacactttggaggatttctgttctcaagcaaaaccttcctcagttcctgatgtataaaaggattccagtgcctgccttcctcccccagagcactggcaggagaaaagcacgccgggcctggggtgctggggggagagggaaacaaaaccaggcactttcccagctcctgggaagggtgggcatggcctgtcctttctatttgctaccacgttgcttcttcaaagtcttaagaagtgaatgttatctcagttttataggtaaagcttagagaagttaagctacttgcccaaggcctcacagcagatgttcggagtagctgggatctgaacccaaagctgtcccatcctgacagcagtggggtcattggtttgctgaattagactttaactgcacatgtgaccaagactccaacccacaaaagatgcacactacttaccaatgccatatattactggaaagtggttttcgttttcttcccggtcatttaattctacaaaataagaatgtttaagatacactttttaaagaaataccaaatgattatttttactttgtataataaaggcgaaggaggagctcctcgatgcagaaagggaggaaaattccagaaaatgaaagggattgtggccctgtttccctaccctgtcccaaggcaggggggtttatactgaacaaactggcagctgcagaatcggtccccactcccaccccaccttctctgtgcaccctgtctgccacacgggtggcagctcctctgagatccagtgccctccttcctggtagacgagggggctgcactggaactgaggctcggcagatggtggacgagggcaaggggaaggggaaggccatcccaccacaggaagagccggaacagatggtggccaagcagtgacagcagtgtgtgccggtgcttgggcccactgcaagactggggacaaaacggtcctgagacccacatctttgctttggggcaaatggcaggacttacctgtcacacataatgtcactaagtgaatgtcatcttcttgcctgtcaaattcacctatgatgagaattttaagaccagaagtcagaaaagttcctctagttaccagaacaaactgctgagcaagccaacgacagggagggacggcagccaactgagtgtgctccgccctacagcccgcgcccacactgccacagcctggcctatggggccagacactagggagctgacaccacagaaccctgaccgccaggagatggccacattctcagcctcaggcccgaaggagcctgggctgagccttcccatttttctcttcattctgagagttttgcggggacccatggatttataagatttttacttttctcctaactaaactgttttcctgattatcagaattacaaaaacaaaaatctggccactgtaacagatctgaaaaatacaagagaacataaggaagtcggtttttaatgtccataatcctaacactgttaataattagtgtattttcttccatatttttctaagctcagcagagctgactataaagacaattttatatcttttttttttttttttttgagatggagtcttgctctgtcacccaggctggagtgcagtggagcgatctctgctcatcgcagtctccacctcccaggttcaagcgattttcctgcctcagcctcccaagtagctgggattacagacttgcgccaccatgcctggctaatttttgtattttcagtagagacagatggggtttcaccatgttggccaggctggtctcgaactcgtgacctaaagtgatccacctgcctcggctgcccaaagttctgggattacaggaatgagccactgcgcccagtcgacaattttatatcctgatttgcttgtgcataggtattttcccatgtaattctcaccctttcatgtgttattttttagcgactacataattattattctgatgacaccagatttcctgttataagtaatgttctaccgctcatcttcaggttcaaatctctatgcacatttcagattattttcttagcatatatttccacaaggggaattactgggtcaaaggatgaactatttatttatttatttatttatttatttattgagacgaagtctcgctctgtcacccaggctggagtgcagtggtgtgatctcagctcactgcaacctccacctcctagattcaagcgattctcctgcctcagcctcctgaatagctgggattacaggcgtgcgccaccatgcccagctaattttttttttttttttttgagatggagtttagctcttgatgcccatgctggagtgcaatggtgtgatctcagctcaccgcaacctatacctcccgggttcaagcggttctcctgcctcagcctcccaagtagctgggattacaggcatgcaccaccatgcctggctaattttgtatttttagtagagacggggtttctccatgttggtcaggctggtcttgaacttctgacctcaagtgatcggcctgccttgaactcccaaagtgctgggattacaggcatgagccaccgcacccggcctaatttttgtaattttagtagagacagagtttcaccatgttgcccaggctggtgtcgaactcctgaccttaggtgatccacctgccttggcctcccaaagtgctgggattacaggcatgagccaccgtgcccggccggatatgaaccttttttaagagttatggcgagaccctgtctccacaaaaaatttaaaaatcagctgggcatggtggcatgcacctagtcacagctacttgggaggctgaggagggaggatcacttgagcccagtaggttgaggctgcagtgagccatgatggcgccactgcactacagcctgagtggcagagtgaggccttcagtcatgatgccaaattgcttcccagacaggctgtaccatcatatgagtaagcttgcttcatggcctggtggttagtcaacacacgacaatgttttctttctttcttttttgaaaatatttgctaatttaggccaggtgtggtgactcacacctgtaatcccagcactttaagaggccgaggcaggtgcatcaccaggtcgggagttcacaaccagcctggccaacatggtgaaaccccatttctaccaaaaatacaaaaattaggtgggtgtggtggcgcacgcctgtgatcccagctactcaggagggtgaggcaagagaattgcttgaacccaggaggcagagcttgcagtgagccgagatcatgctactgcactccaacttgggcaacagagcaagactacatctcaaaaaaagaaaaaaaaagaaaaaatttgctaatagggaaaaaatggtatcatcagtgttttaattttctgcagattaaaatggacatttttgccaggagggagggtggctctgctttcacacaattcagagcacttactattttggaatgtgttcactgctgttttagtagaaaatcttgtccccagccctgctacccctccctacacatgagctccacgcattcagtctttctgtgaaattccaagctgggcagtctgtttctctgtgctgctccaagtgggtgtgcccttcttgggttttgtaccaattgggatttttaacccaagcaaatatgggtacatatttatgtccaatttgggggaaagaaaaaaaaaatgaacttactaagaagttgatgagtgagtttttgtgacaactgcctgtcgtcactgaagcctccaacaaggtgtacttccagcctggcaaagagatgagacgggtcagaggccagaagaagacaccggtgcgtgcgctggtctcactttgaactttcattctcagtttccatgaacacttgctctacagcagagctgcaggtcatcttcgtgccaccgcaaaagaaagtatcggcagcacactgccaaggccagtggcgagcttctggggaccctgcccaggggccctgatgactgaggggatccgtatctgaacacaaatgtgatgccgcctccatgcaccagtggggaactttgctctggaagagcacaggcacaggacaggtgcagtggctcacatctgtaatcctagcactttgggaggctgaggtgggcggatcacttgaggttaggagtcttgagaccagcctggccaacatggtaaaaccccatctctactaaaaatacaaaaattaggccgggcgcagtggctcacgcctgtaatcccagcactttgggaggctgaggcgggcagattgcttgagctcaggagtttgcaaccagcctgggcaacaaggtaaaactccatctctactaaaatacaaaaaaaaattagctggacattatggcatgtgcctgtagtcccagctacttgggaggctaaggcaggagaactgcttgaccctgggaggcagaggttgcagtgagtcaagatcgtgccactgcactccagcttgggctacagagtaagactctatctcaaaaaaaaaaaaaaaaagaaaagaaattagccgggcatggtggcacacctgtaatcccagctactcgggaagctgaggcaggagaattgcttgaacctgggaggcagaggttgcagtgagctgagatcgcgccactgcactccagctctgggcaatcgagcaagactccgtctcagggggaaaaaataaataagtaagttgggcgtggtggtgggcgtctgtaatcccggctactcgggaggctgaggcaggagaatcacttggacccaggaggcagaggttgcagtgagccaagattgcatcactgcatgccagcctgggtgacagagccagactctgtctcaaaaaaaaaaaaaaaaggtttgaggccaggtgtgctggcatatacctctattcccagctacgcgggaggcagaggtggaaggaatgcttcagcccagaagtttgagactagcctgggtgacagggtgaaaccccggctctaaaacaaaaacaaaacaaaacaaaaagactgggcaactgcctgctggaagccctccttaggagtcacactgcgcattgcacagtgaagctcttgagaagtcctgcgactgaaaaatccaactaactttcttgaacccagtgtttcccacactcatctactaacccccttttccacagcccgtcaagtgggcgaattcacgctcggcaaagtgttgccagactttacgctgccttctcagacacaaaatcttcctaagggatgaaccagaagcttggatgtacccaacatagggcacagcctcaaggggcctcataataaactccaagtagtagcagtaaggagagctgcgaccaccatggctttgccactgggccaccaggtttgcctctgactccctgagcgatcacagttctacaacagatcaggaagagctgacaagcacgttctgagaaccacggagcagagtgtgtggcaacataatggcattgattacgtccccctgcgggggccaagatgataggaaaatgaaaataccattttgggcctgcatgggtcacgtgtccatgaagccagcccagccttggcacagaccacagagggagaatttagaatcgaccagtattgactagcaaatctctcccagagaactctctctttcctttttagactcctaggattaagccttcgtatatgatgggagtagttcactcaatggctgccttagacttccagtaaaatgagagcaacacctgccaggtctccacaaagagcaaggagaggggacaggtgtgtgaacagtggtcttgacagcaggcctgtgtcgtcggcctccacctagctcctgtgtgctccagcacatcgagcctcagttgcccgtctctgtcaaatggaggcagcggctactttactgcagtgagagaggatgaggtgctgtgggggcacccaggctagaggccgcttcttatccagcaatccttggggaaactaccaatctgctggaatttaaaactatacccctcagctgggaggatcacttgagcccaagagtttaagaccggcctgggcaacttggcaaaaccctgtctctaccaaaaaaaaaaaaaaaaaaaaaaaaaaagctagctgggtatggtggtgtacacctgtggtcccagctacttgggaggctgaggtcggagaatcacctgagtccacaaagtcaaggctgcagtaagctgagatcacacaactgtgctccagacagggcgacacagcaagaccctatctcaacaacaaaaagagaacaagaaaaaaaactacatgcctcgccccctagcggtccccacatcttcctggcctcgttttctccacagccccgcctcaccacccaacaccccatcttgtgtacagtctctcggcttcggaatacaaacaccttgggccgggctttctgtctactcttcactgctgtgtccctagaaactacaaggtgtaggtgagaggaagcatttaacaagcaactgcgggaggaatgactgcatggagagctaccacacccgggggagagcaaaacgatgtgaaaatcgcaacctcgacgttcctgagacgacatcaagttcaaagtcaagccttccatctcaaatccagcacagactccttgcctgtgcccagcacccactcattcactcaaccactgctgacgcagtgcccacgtcgtgccaggttctgttccaggggaacgaggcagacacggcagtggtggcatcctgtgttcccctaacagcttccacagccacgtcctgtatgcgacggttccaagatctcaattcacctatgagagcagcgtagatctcaccttccacattgagcgtggtcagaaaaggattttatggagttcatgatcaaggggacctcagctttggtgtcggttccgtcacaatgtgtcaagcaggtggccccattacctgaagaacaagggtgaaaggactcaagttattccctgatgcgagtgcagtgcgcaggccgagactccgcctgtccctccggaccgcctcatctttgaatatcctgtaggggaaaaacggacaggtctgtgctccccagccaacccattctgaccaggacaccagggagacaccatgcagaccagaaaaaaggtaagcggagtccgcttccaacaagacaccaggaaactcaacacgagaaattcaatggtcccaaaggttgggtcagtttaagtaatggtttccttcacctctctcatcatacctgtgtgcctcaggaccacaatgtgacaagtagtggcatcatcagaacccagaatggagatggagcctgtttaaaaaagaaataaaataaaatatccaatagccttttgggataacgcccaattcactgcttcctaacctaccatcctttggggaggtcactgcaagctctctttgctgaacatacagaaggccctggggtcccacttgttgaacagactgacctctgagaagtctggctctttcctgtttaattaaaaaaaaaataaaatagtgatgtaaattagtgaggatggaaaaactaaagatgtggagagagccaaagtgggctctgcgtgggcagcacgctagtgtgtggggagtgtgttagtggacagagaggctcaaagaaaaaggcagcagccacggtcattcagaacaatgcagagaaaacgatgcggttctgcgcggtggtttttttaacctatgaaatcggatgtcatagtaacctatgaaatgagatgcaaaaatcctttattatagttttttgtttgtttgtttgttttttaaagacacagggcctcactatgttgcccaggctggtcttgaactcctgggctcaagcaatcttcctgccttggcctcccaaagtgctgggattacaggcatgacccaccacacccagctatcacagttctttactaaagagtgtgagactcttaacaattttaccattgtaaagagaatcagattacacaggaatagtggatggatggctctgaaatcacatcccctcttttttattttttgagacagtctctcactctgtcacccaagctggagtatagtggtacaatttcaactcactgcagcctccacctcccaggctcaagcgatcctaccaccttagcctcccaaatagctgggactacaggcttgcaccaccacacctggctgagttttatactttttgtagcgacggggtctccctatgctccccaggctggtctcaaactcctgggctcaagcaatccacccaccctggcctcctaaagtgctgggagtacaggcacacaccaccacacctggctgatttttatactttttgtagagatgaggcctccctatgctgcccaggctggtctcaaactcctgggctcaagcaatccacccaccctggcctcccaaagtgctgggagtacaggcacacaccgccacacctggctgagttttatactttttgtagcgacggggtctccctatgctccccaggctggtctcaaactcctgggctcaagcaatccacccaccctggcctcccaaagtgctgggagtacaggcacacaccgccacacctggctgatttttatactttttgtagagatggggcctccctatgctgcccaggctggtctcaaactcttggactcaagtgatccacccaccttggcctcctacagtgctgggattacatgcataagccaccatacctggcctccgcttttttaccttagtccctaacctagtaatttcacttctggaaatctgtcctaaggaaataactcaaaatatgttcatccctgtgttatttcttttatcttattttttttttttgagacagagtctcgctctgttgcccaggctggagtgcagtggcgtgatctcagttcactgcaatctccacctcccaggttcaagcgattctcgtgcctcagcctccccagtagctgggattacaggtgtgcgccaccatgcccagcttttcgtatttttagtagaaactgggtttcgccatgttggccacactggtatcaaactcctggcctcaagtgatccacctgccttggcctcccaaggtgctgggattatagcatgagccaccatgcccagccccctgtgtaatttgtaatggcaaaaagctgggagcagcaatggaaaaggtaagtaaattgggcacagaaccaagtcacagccactaactgcacagtcatgagaaatgaaaactatgggaaaaagagttttgaaatgctaattgaaaagcaagatacaaaagtataaaaaatgttttaaagagctataaatgtgccataatacaacaatgattaaatgcttatacccatagagaaaaatactggaaggaaatttcaccagtacaaccatggctgtgccaaaaaagcaaacatgagtgatttcctgttgctgttgtcctctcttctctcaatgttctatcacatagttattgttagaatacaaaaacaaaatggataaggcaaatttacgaaaggtatgttaatactaagtgtcaataatctgagtgtttgtacacacttatttagtaagcttgtaaaaaaaattcagtggttaaaaattcagtggttatttaacaaaaactttttcaaaatattaaattgatacaacactacaatgtatcataatttccttcttacttgcaacaaactcctggatgaacaaaatcttcctcaaatgtctagacaacgtatgtatgtattgcctacacaggaagacagttttgcagtcttagtcttctatcagcttcttgccatttcgcatgactggtgctaatttaggttagcgctcacttaataaaacataagagcagctgggtgtgatggctcccaactgtaattccagcactttgggaggctgaggagggaggactgcttgagcctaagagttcaaaaccagcctgggcaacaaggaagatcctgtctctacaaaaattacaaaaattagctgggtgtggtggcatgtgcctgtagtcccagctactctggaggctcaggtaggaggatcacttgcagccaggaggtggaggctgcagcgagccatgattgcaccactgcactccagcctgggtgacagaccaagaccctgcctcaaaaaaaaaaaaattaagattaaactaaaagaagagatgtaataaacataatgatcagcttgattacttacatggtgttttcttctgtttataaacttccattaactggaagcaaggtatcaatgaaaatgagacaagccccttaatttaagaaacaaactaaagattaaatgaactgcagtgtaaaattagatgggcaagacagccttgcttgctccagaagtcagtgagaaacaggtgtgactgctctaaaactcagaacacctgtacaggtgacagcctctcattttctcattccacttcttgcctcatcttagttcagaataacaggggagaattcagaattccctcttgattactcctgagatacttaccttctgctttgttctttgagggaagggaagagaagggagggcgcaaaggcgaatttttaacactcatgttcacaattgggtcaccactcaaaagcaaagctatttgtgagaaattaattactgctttcacaaagaccaaaaatcatgtctctcttcaacacagctcctacgatttcccaaagaaataaaagcaaaaattatcagaagagagaatgccagaaaactaaaacagtagactgctttgctctattttttaatttctttttttaaacagggtcttactgtctcccaggctggagtgcagcggcgagatcgtggctcactgcagcctctggcctcaagcaatcctcccacctcagcctcccaaggagctgggaactacaggcatgagccgacacacctggctagtttttgtactgtttgtagagatggggtctccctgtgttgcccaggctggtctcgaactcctggcctcaggtgatcctcctgcttcagcctcctttgcagtagctggaaccacaggcgcacgccaccacacttgtgctaggattataggcatgagccactgtgcccagcctctactttatttttaatttttttttttttttttttagagacaaggcctcactctgttgcccaggctgaagtgctgtggccagatcatagctcactgcaacctcaaactcctgggctcaagcaatcctcccacctcagcctcctttgcagtagctggaaccacaggcgcacgccaccacacttggctaatttttgctcttttaagtagtaaaaagagtttagccaaacttcccttctttggaaaaccacacagtcctactttataaattcatatgcaagtagtcccagttttcttaacctctaatatgctctagacactaatatttgcttaaaaaaaaaaaagcttttccctcagtccctcatccctatttcccagttcctattcaatggcagtattctcttaacccagtgaccagcagattttctgaaaaaggccagacagtaaatatttggggttctacaaggccgcagtctctgtcacaattgctcaactctgctgttattatgaagtgaaagcagccatagacaatacagatgtggctgtgttccaataaaactttatttataggtgacaccgaagttttaatttcaataccatttcccatgttacaaaatattattttgatttttctcaacctttgagaaatataaagaccattcttggcctataggctatacataagcagggtccggcccatgagctgtggcttgttgacctgtgtcttagccaatcacctagctgtgacctgggggatgatcatgtgaccctcacccctgctgtcctgtttatcaattcttcctttataaacaggagaggggcatgaaggtgatctgtgaactgtaaagcacaatgctatataagaaattatgaggcccaacacactggctcacgcctgtaatcccagcactttggaggccgaggcgagatgatcgcttgaggtcaggagtttcagaccagcctggccaacatgttgaagccccatctctactaaaaatacaaaaattagccgggcatggtggcagatgtctgatactcaggaggctgtggcaggagaatcacttgaacctgggaggcagaggttgtagtgagccaagatcgtgccattgcactccagcctgggtgacagagcaaggctctgtctctcaaaaaaaaaataaataaataaataataaaagcaggaactaagctacgctgcgagcatcttgtagactctgtggaaccgtattacccaagatgttgcaggactggttaccgagtacccagtgactggttaagagtgactaagggagggctctaaacagctctggccaaaggaacttcatgctgggatggccaccgtctatattcacactgtctcattagtagccatgctgtctgctcggcacttgaaatgtggctactgcaactgaggaactgagtttcaattttatctaattttaattgatttttaagttaaatcctaagtaaccagatggctcgtggctactgtactgaatagcgcagctccagagtcaagggcaggctgccagggttccaatcctggcttcaccactcccaggatgtggggcctggggccagtttcccagcctctctgtgccccacagtcctcatctgtaaaatgggaatagcagtaactcttgctgtggtgcttggcagcttccactgtatgacttattgttattatttgctagtcatagctacacacaggcttctaactgttggtactccatactcagaacacatcgttacatgaaaaagacacattataaaacaacatatagtaagctatcatttttttaaaaaaagtaaattatatacaaagaaaaaccttcattaggactttcaccaaactaaagaatggttgtagtcatacttttttttctgtattattatattttgctttcctacaaagaggacaccctgttttattatataaaaataatccaggccaggtggagtggctcacaccggtaatcccagcactttgggaggccgagacgggcagatcacttgaggtcaggagttcaagaacagcctggccaacatggtgaaaacccgtctctactaaaaataaaaaaattagctgggtgtggtggcatgcacctgtaatcccagctacttgggaggctgaggcaggagaatcgcttgaaccttgggagacagaggttgcagtgagccgagattgtgccacagcaatccagcctgggccacagaacaaaactaagtctcaaaaaaaccaaccaaccaaacaaacaaacaaaaaacccaacctttaatgtctccctgttgctaagtaggtgaaaggtccatctaagccccttggtcatttggtcatctgggtacaatccacccctgtaaggttactttccatgcttcccctcctcacccgggctgctccggagaaactggccaggacacccacccactgggcccttcccctcctgcccgccgcgccccaggcggcttgcccagctgcgatgccctcacccttcttctccttttcaaatctctctcgtgcctgcatccttcttcacttacactgccgcaaatcaaagtgatcgcccccttccaaagttcctgtaacacaaactggtccccagtacacagcctttctaggacatgtcttcttaaataggccaaaaccttccttcgagagaagcagccccggtatgtcaccaaatctccctccacacttaagtgtgcagcccgggacacccatctaactttctatcacggacattttcaaacagacataaaagtagagcatcccctaaattcttcaggcggctgaaattatttttccttggtgagtcctactcttgacttcgctagctaacaggacagtaacacaacgcaaggataaagtgacacgccaccacgcctagctcggtgcatgttggctaacagacgatggtcggtcctgaaatgcaagctgagaatcacacagagctgtctgccttctccccgtcagtaagtccttgtcacccttcagaacacgttcaggggtcattttgtgacctcatttatgcagcaaatctttactgagcgccaattctatgccagggaccgtcctacactctgaggatacaaaagtgaggacactactcttatctgccttcaggaggcttacattctggcgacagaccaatagagaacaaacaagcaaacaaaataatcacaaactgtacagctgtgacagatgaaacctctaaatgccttccccaacccaacacacttggtcaggttcctgtgcttcccatctcagagtgaaaggggacgctttttctttatggtacttaacagtttatagtatctgagccttcttcatcagaaaccattctcccttctagactataaacactccgagggcagggacagtgatcagtacgttgcccaacagatattaggggctcgatatttgactctcaaatcaaggaactgattgattcccctttaacaggatctatggcaaataggacgtctgcccccgccgccacgccccgctctttttaaaacctgagaacccccttgccaacagtccctgcataagcgtggacaagagttcagagatctatttgagcacaaaagcagaaaaaacaaaaacaaaacccgtgcatcagggcgtggtcctatggcccagctgcggaaagcagggctctctctcccggctaaaaataactcggcgccctacgccccgggggtaggggagagagaggaggaaggactgggggtccccgccaagatcccccaggccaaacgctctccgaagcccaccctggaataacctcctgcttcacggggacgcaaggacgaagcaacgttcaccgcaggctgcgggtccccgaaggcgggcggccggatttgcctaaacggacccagccctatgggggctgcagccgccccgtcggggaatgggggtcccggcgtgtccccgagccgcagtgctgtgcgaccttgggcaagtcacctaacctctctgggcccccgtcccctcccttgtcagagagtggcctccggggcagcccgctgaagtctaaagaaggcaaaaactccccgacccctcaaggggaagacgcgagccgacggccggggctccggatgtgccaacagcgccaagtttcaagtctgtgtcgcgtgaggggggcgctagcccgccctgcagcttcccctcgggcccgccccgaagccccgcgccgcgccccactcacctccaaaggcgggtgggctcggacgaggtccccggctgactgcggcagccgcactcgccgcccctcgacgagcagcggcatcgcggaggcggccgcccaggcaggcccagggaggcggcggccccccgctttgcagccccgggccgcccgccgcccccgcccctcgggccgcgcgtcccgcctcgtcctgccccgccccaccgcgggcgctgccgggaagtggagtccaggcggaggcggtgccggccgaagagactggagaaatccaggacatggccgcaaggcctcacgggaaatgtagtccaaagccaggaagtggccctggaagcagcgcgcggcccgcctcctccgcaaggggcgctgggaagtgtagtcccaaaagcgtgggagtgaaggagcggggaaaggagagctgccagggagcagctgcaccagccaagagagcctccgggcgagttcctggggcgggttctggctccgactgctgcgctttaggtcattgctccacgcttcccaggtgtgtgaccttccacaagcttgagtttgggaccctgctgtgcagctccgtaggattgcattcaatgagtaataataaacctaatcaggcgggcacggtggctcacgcctgtaatcccagcactttggggggccgaggcaggaggatcgcttgaggccaggagttcgagaccagcctgggcaacatagtgagacccaccctcccccataccctcgtctctgccaaaaatttaaaaattaactgggcacggtggcatgcacctgtgatcccagccactctgtaggctgaggcgggaggatctcttgaccccaggagtgggaggctgcaatgagctatgtttgggcactgcagagggacactctgtttctgaaaataataaaaataaatgtaaacggtcttaaactgagaaaatagatcctgaactgtgctagccccacgtactaaagagatcatcgattaacacgtcgtgattggaatgcaataggccactcacaggtgggctgggaaccgtgggggaaggatttgcggatactgactgcagagcccctaatctgaggacaggtccccaaggtgagaggcgtctcaccgtggagctctcttctaaaacttggaaatattgctcaaattcatccaactctgcagcacattaacaaaaagtaattttacaaaagatacagaggagccacatgatacagcagaaactttattagaattttatcatctgtattcatcgtcttctttcataaatctccccctcagcttacacaccccgttcaacaaaaataccaggaaatttactaaagaaatgactgtagaagatggtgttcccatcgccaggttacccaacttctcacccaaaataactctatttctagctaccaggaaattatttctctgtattattacacctacatttctcatttgtccttacaaatgtaggagctactatcaacacctcatttgtcatttgtcctcacaaatgtaggagctactatcaacacctccgttataacagatacagtaacttgctcaaagtggtagaaataagtagtagaacgaagactgaacctagctttgcatgattccaaaggcagtgctctccatcactataagatgctcctagactgtactgtaaacaactcattctaatgcaggtgacattaagtaagtcccaactaggaagctcggagctaaaaacagggtttgaaaccagggtgatcaatgaccagcaggctggcctggagcaagttacttaacttccctgaactggttttgtagaatagcatgtttgtttcacctggtacatactaaacactaaagatagctattattggaattgcagagcaaagagtagtcaatcaaagtgaggcatttggaagtgcaaaggtgaagaacaaggttctgtgggttctgcctggggctggtgcagtttgcctaactggtttttcacttttgggtgatcttttttcaagtaatctcaggttatcaatctcctaggctgagtactgtgttaaaggactaaatgagccagataacaagcaggaaaccactcccctacctctcttcccacccagctccacaaattttggtctacaggcaatgaggaagcaatagcaggtgtgtggccagcactgcggctcatgcctgtaaccccagcactttgaaaggccgaaggaggactcacttgagcccagaagttcgagacgagcctggacaacacagggatccctgcttctccaacaaatacaaaaattagctgggcatggtggcaggcctgtagtcccagctactcgggaggatcaatcaagccctagaggtcaaggctgcaatgaggcacgactgtgccactgcactcctgcctgggtgattacagcaagaccgtctcaaaaaaaaaagaaaaagaaaaagaaagcactaattacaatgttggaaagcctgtttctttaagataggaaaccaacctgcctcacaagatggctgatggcaaagttcaaagaatatatacagggaaatattttttaaattacacttttttgaggccagacatggtggctcacgcctgtaatcccagcactttgggaggccgaggcggacagattgcttgaggttaggagttcaagaccagcctggccaacatagtgaaactccatctctactaaaaatacaaaaattagccaggcatggtggtgcgtacctgtagtcccagctactcaggagactgaggtgggcggatcacttgagcccaggaggcggaggttgcagttgttgagctgtgattgcaccactgcactccagcctgggtgacagagtgagactcttgtctcaaaaaaaagaatgatgaacattatacagaaccttagtaaatatttagtgaaaggatcccaatttgtgtttcaaattttttaatgtagagatgggggtctcactatgttgccccagctgatctcaaactcctggcttcaagagatccttttgctggcctccccaagtgctcagattacaggcatgagctaccacacctggccccaaattattagatacattataaatcctactcaaccatccagagtcagactgaaacacacaaaagcatttgatggaagaaaacatggtggagctttggatgttcaattagttgaaacaagaaaagtatgcagttgtacaccaatgaacagttctcaaggcagcctgcaccttcgaatcaccagggggctttaaaaaccatccatgtccagacccctcttctggagactgattcaatcaaaggttgagttggtgtgtgacgtgagcctgggcatccttagtttctcagcactccaagggactgattctagggcacagccagggttaagaaccaccatcgtaagcactgcccggcaagggaaacacgctggttcctcctctccagttcagatctaagttggtaccagggaggtaggtattatggaagaaatagaagttatctttaaccaaaaaaaacttcccatggaagtgcttcctttcttgcaagaaaacaacagccattaacttgtacatgcatcgaatccttaaagccttacactagtatcttattcccattttacagtttaattagcgctcagagaggttaggtaacttgctcaacgtcaaacagctagctaggaaaggaagcccatggcacttggtaagttgacttgtaaaaattcagccacttctcatcaaggaagaccaaaccagagcacacagacaaaaggacagaccctggagactcctacaactgacagctttttagtgaaaggaaaaattcccattgttggcatgtaatttataaggagatttcacagtatttttccccatagatgtcccttcaaagcatgtaactttttgaaagaagtgtctgcttcccttggacctgctcaagcctcaatcactctttgctgggtgtgattaaggagagtcgcggatacttcatatagtgcacacggaaaccatcctcaccccggcatgcaatgaattccatcaagctccccgccacaccagcactatttctccctcttcaacagcaatgcctcaggagttttccactgcaaaatgctttaatacattaaattaaaaaaaaaaaaacaaaacagaaattgaaagaacatgtattgaggtaccttttattggtataagaacgtaagttccagattaaccatgtcattgtttcattttcaccatggattttttttcacaaactcctttgaaattaaacagacttatatgtaaatgtctttctacattaaaactacttcccaacccacaaagaccccacttactactaatttctggggaatttcgtttactcgttttatctaatattaaaaaatcaacattttgccagcagttaaaaagacaaccttaaagttctcaaattactttccaccaaacccggaaaagaaaaccacccatatccaaaactttaaagcaataaaaatttctattttccaaaaaagtatttacagactgaaattcaaactctacattgccatcaatgtaattatacaagtgcatacaaagccctggaaaagaggaagtatttcattacaaaatatttatgatcaagaaaatattgcttgcctttaaataaagtggcagaaaataaatatgcttaaagatggccattttcacaagtaaacaaaaaagtacacatgtaagaaacaaagtgaaaatgcttgagcttcaaaatgactctagcagtgtttgcacaaatttgttttaaagcgaggtcttctgaagacttcctctgtttagttataaaaatacaaaaagaggctttagagaaggatttcaccaagccgaatgtgcgatgcacacagccatcagaccaagactgcactagcaacttccacctattgttgtgagcaaaaccgtacaccaaataatctaaaaaaattttcctgtttccaacaaagaaattcccaataactaagtgatgcagatcaaaactgactcgatctaatggccaccaaggagcagttctagatctaaggggacacttgagagccaaggggtcaaatccaatctcatgtgttttacacaagcccgaactcactttcagtctgtgtgaattacatctacctggacctccatttttgtcttttaaatccattttttcgctgtgccaagtatattacacatctgattctgtttccctatatcctctctctcttccctatgggcttttattggtctctgaagtccctggagatcttcagtgccagctccaactctgtgtcccagaccatgtcgggccagctctcagctttccttctgtcttctctacactcccttgaaatcccaacagacaaataccaatacagcagaaggtgaacaatgtagccaaaataaacactttctagttaaagtctttaaatagaagttttatcttagaggattcttcactgaaagctcatcagtcaagtcctaagaccatggatctgacaaaaacccatgttaaaacagcaacccgtaaaacagtctgctgcctatattagaaattacccagtaattgtgtcaaaaagctgttaacacaaaaaatgtacatattaaacaagcaaatccttccaaatgtatcatcaaccccactgtaaaagattgcacatgatagtcttcattttgtctgtaaggggaacaacaacaacaaaaaaacccagtcttcagatgcttgattcagtcgaacctggaagtgccacagccgaggcaggcactcgctctagttcaatgccatcaatgcccaatggcacaagctgggtgctgagggcatgacaagtgatggggaatcccaaatgtcacatctcagtcacaaatttctgccgtcagaggggactgggttgcatgtacaacacgggtggggagcccacactacttgaaggacttcggaaatgcgtgtcaaaggagcttggtgtgatcccaatcacggtatcattctggggcacttcgcctttcagaaagtcatcatcttcatcttccactatgtcctgcagaaacatcagaaatcatcagtaacatcaccagtgctgactgaaaagctttcaacaattccttcctcaggaaggtgttaacgtttgtaaagatggtgaagaaaatatcttaatttcaaaagaaagccagtgtagtggcacacgcctgtagtcccagctactcaggaggtggaggtgggaggactgcttgagctcaagagttccgaatccagcctgggcaacatagcgagaccatgtctctagaaaaacagaacagaacaaaagctccctctgataagcacttccttcttaccaacatacccacataactgctcatcacacattgtaatcatttgtttcaagtctgacttgcaaacagatttgaagctcaatggggacaggaaacatgacgagtcattcttgcccagtgttaggaactcttgtacctaacacaatgtgaatgaattacacgcccctcaacaaatgaaacataaagaaaaagatgaaaggggctttccaatgattacttattaaaaacaacaacaaaaaagccatcttgaagctgcttttaatgagaaaacaaatgtgctcccaagcaacagagcagcgaaattctttattactggattctaactttcctctctaactgtaactgtctcagctccacctcatgtgacctggagggtatgttgcaacctgcgtcttcaccacccattcatgaagatctataaaactaatgtaaactgctggggcaatttcaacatgagtcaactggagattgttacttggtaagaatgcgcaagtggcaaagatctaaattcattcagctaatttgtaattaaccttcgcttctcacatgtcagtatgtgaagtgtctggtttaagcaatttatccaaaaaagccatagactctttaaataacaacaaaacctgggcctggaattttataaaggcagaatgagtaagacacggttttggtgtgcttttttaaagaaaacagggtcttgctctgttgcccaggatgaagtgccatgctgcatttacagctcactgcagccttgacctcccacctcagcttccagaggagctgggattacaggtgtgcaccaccacgcccagctaattaaaaaaatttttgtagaaacagggtgtcactgtgttgcccaggctggtctccagcaatcctctggccttgaccccctaaagtgcggggattacacgcacgaacgacttgccacttactatctcactgtgacctggaaccagaaaggagattccgagagtgtgctcaatcaatcacaaactgacctttttcatgggtttcttgaactcctgtagctcttcagcactcatgtcttcccacacctgataaataggatcaatgaatttctttgacctgtcaacaaagatcacatttcaaagtcaagttaaatacttcggcagaagtcaaaattggtttggatcttttctcacaagatctattacccaaaaccaagaagtgaaaactacagcttaaataattacatttaaaaaaaacctggctgggtgcagtggctcacgcctgtaatcccagcactttgggaggctgaggtgggcagatcatgaggtcaggagatcgagaccatcctggctaacacggtgaaaccccatctctactaaaaatacaaaaaattagccgggtgtggtggcggacacctgtagtcccagctactcgggaggctgaggcagaatggcctgaacctgggagacggagcttgcagcgagccgagatcgcgccactgcactccagcctgggagacagagcaagactctgtctcaaaaaaaaaaaaaaaaaagaaaaaaacaaaacaaaaaaacaaccctctatgtaaatgctgtaactaatgtggctctttctgtataagagttcattcactcatgtcgatggagtattgaactaccgtttttcatctttccattttcatgtgaaattgtttctaaactttacaaagactcacaagtcagttagatacagtatatccaaatggaaatgaaaccgtaatattctggaactctcttttttatatttctgtagtaatttgctgaaaagtaagtctaggaaaaacaactaatctggtttcagtcaaccaagacttcagggaccagacaatcccagatggtcatgatgctgctagttattttagaaaccataataagcaaaaatcctgcttccttatacaagtgccaagttaaggctggcccagtggttttctagaacaactcatctagataaatcgctttttgttttttttttgttttgtttttctgagacagagtctcactctctcgcccaggctggagtgcattggtgcaatctcggctcactgcaacctccacctcccgggttcaagagattctcctgcctcagcctcccgagtagctggaattacaggcgccaccaccacacccagctaatttttgtatttttagtaaagacagcgtttcaccatcttggctaggctggtcttgaactcctgacttcaagtgatccgcccgcctcagcctcccaaagtgctgggattacaggcatgagccattacgcccagccaatcgtttgtttttcgtttatcctgtgcaacagaatggtatgtggtctctagaggaaggaacaagacacttggcagaaaattatgaagcaagaaaagacagcaccctcccctatcctggcaccattatccccattaaccttacatgtttaaataacagtttaaagaaaaacaaaaaacaaaaaacccttgatgtcagtctggctcctagtgaggcaaagatctacccactctggggtgcctgcgccactcggcaagtcctgctaggcatcctctactttgcatctggtgaaatatacgcagggagaccacgagatgctcatcaacagcgaggaagggccacttctggtgaagagccctaaatcccaattttgggaaaagcaaacatgtatcacgtttaaatccacctcctggccgggcgcggtggctcacgcctgtaatcccagcactttgggaggccgaggcgggcggatcacgaggtcaggagatcgagaacatcccggctaacacagtcaaaccccgtctctactaaaaatacaaaaaattagccaggcgtggcagtgggtgcctgtagtcccagctactcgggaggctgagtcaggagaatggtgtgaacccgggaggcggagcttgcggtaagccgagatcacaccaccgcactccagcctgggcgacagagtgagactccgtctcaaaaaaaaaaaaaaaatccacctcctccagcgtcaatgtttaaaagtacctacctcttcagcacacagggatcaaaggggaagaaggtgtccagcgggtttgtgcagatctgcactgagtctcctccagcggtactcctaatgactggcagcatctggcgattgttcctctcaatgatggtgtagcagaagacgagctggtacttactgtggaacaaaaaaacaacacagacagaggcattaacatgctggagtgactcggtgcagatgtgagctgcgtgtgacaactgtacctaccacagagaaattgctgaatataacaagtgctagtaaaaataacaatataaagcagaaagtaacacttttagggtaccgttctatgggtcttctatttgcaagtttgctaaggagaaagaaaacgtggctatcactcagaatgtgaaactgggcttatattttaatgagtaatagatattattcattatattttaatgagtaatagatactattcattaaaaataaatgtttgcaaggcaaaactcttagattacgtaactataggtgtctttatttttactgtttgcaaaagaattagaaggttggtggtaaagggattcaggagttactcaggaggaaatagtggttggtgaagagacttgctgaagaagcactgaaaaagaaataagcctttactgaaggagggacacggggttgactaagtcatgacctcaaaaacaggcacagaaaggactaggcatgccgagtgagaacagttaaatgcatagaagaaaacataaaataaagacaattatgtttttaatttttccagtagttgtctctaaatgattgagcaacttgaaaaattatctattggacagcttctccaagatgaggactcagatctcacttctgtcactctccatctcaggttctcaggtcaccatggcaacttcaagccacatactttgatttctgtcctgttagccaaggctcacagcacttgacccctcctcctggtggaggacacatcagcaaaaccacactggagggtggtttgcactatcaggtaaagttgaagatctgcatctcctacaaccccgcagctgaccgcacttccgggtgtgtgacaaggaagcatgtgcccacacacaagaatgttcctgagcactaaaacactaacacagccggctgggcacggtggctcacacctgtaatcccagcactttgggaggttgaggcaggcggttcacttgagctcaggagtttgagaccagcctggtcaacatgatgaaaccccatctctactaaaaatacaaaaattagctgggcgtggtggcaggcgcctgtagtcccagctattcgggaggctgaggcaggagaactgcatgagcctcggaggtggtggttgtagtgagctaagatcacgccactgtactccagcctgggtgacagagcaagaccttgtctcaaataaaaaaaaaaaaaaagacaaaaactaacagatgaaatcccaacaaagactcaataaaaaagattcccagaacataacacagcagttaaaatcaaaataaagctttgtgtcaatatggttcaatctcaaaagcatcaagcaggcaaaagcaacagctacagaatggtacacgcctttatttaccatatctgtacctaggcagagacttttatttcaatcccctgctcttagcctcacatcgcatcacactctgtgcctccaatgcgcatgccaaccccaaatcgagagcccctggaccagatggttcacaaatgcagtcctctgtccccaccccgagaacataccaggggcagcggcctctgctttgcttcatccatcctcactctttgagctgctcaccatcttaaccaacgtgctgaagcctccacccactcactgccgttgcttattggtctctttatgccttttcctaatcctttactatcactgagactcagaagagaggacaccttgaaccagacgcctagcaaaggagaactaaagaggctgacggagctcagcaagctgttggctcttatctgttgaagattttaagctatgatccggcctaaatatcctcattgaatattcaattctccaattcgctttctccataaagcagaataacttagtgaaagcttacaaaggagccagactacatttaaatctgtgctgccagtctagctctatgactttaggcaagtgatttcacctctctgtacctccacctccctgttgataaacagggtttcatcctagaggatcaaatgagttctatgtaaagtgcttagaactgcctggcacagaggaaaggctatggattagccatagctaccagacctgagagaacagaactctctaaaccaatctcttacaggtcaacatttgcctcatgtccagtttatttctattactattacaggagtcactctaataagcatctatggctttgcccctctcagcttactggttgccatacttatttcaaagtgctgccctttggataagaagtagtagtaatttccaacgccatcaaagtataaaaacaatagctgtatcacagtatttcctgcaaggactgggttgtttttgtttgtttaagagacagggtctcattctggagcccagactggagtgcagtggtacaatcagggctcactgcatccttgacttcctgggctcaagtgatcctcctacctcagcctcctgagtagttgggactacaggcacaggcaaccacacccagctaatttttaaaatttttttgtagagatagggtctcactatgttgctcaggctggtcttttaactcctggcctcaagcaatcctcccacctcagcctcccaaaatgttgagattacaggtgtcagccaccacgcctggccttttataatgttactaatttcatagaaatttaacactcttacaatactagataaacataaataaaaatattttaaataactcccatcaagaaagcgtaaataacttactttgtgattgcagcaaaaaagttaaccactgagggcaggcaaatcttcaggggatttagctggctcatcactatccgctcaaaattcagactctgaagatactgcaaacctttggtttaaaaaaaaaaaagatttttttaaaggtacaaataagtgaaaagtgtaagatacttttaaaagcacaaattatcacacatttaaaaaaaactttaaaaaattatttgcagaaatgctttaaataaaggtccatgcagatagtcacacagtatatggcccagaagagtatcactaggctaaccacattcattggtcaccaaggcagcttctctaaagaaaacttaggaagtagcaggctgtaagattccacgacaatgtgaaattcatatgtttgcaagctcagtgtatgctgagataatacagagggagaaaagaccttgtgatttggtttcagctaacaatcatgacaggcaacaaaacaaaacagcaatttgattctagcttgcatgtcttgttagtgaagctgagtgctgttttcaggtgcacagtagtcatctgtagttttttttctaaacaagaaaactccaaatttgccttctacctcaacggacggcaaatttagacagaaaccactttcttagacttaatgaatataattcttttctacatgagtaaaataaagacatcacatttattttaagaggcaagctgaccaacttgtacttaagtatattttcttaggagtttctttgatacgtatttcaataaaaattacctaaatgggatgtcacagcttacaaaaacaagatatttaatccagattcctggcattaatttatacaaagaaaagcagagcttgtatttacttaccttgtgataaaacctcatcctactagttcatacaacatcttttagaagcatgtaggatgtaggtaaacatatataatgcaacacatacaactttcagtttagagctgtggctgttaacccaaggagactgcgacccccgcagaggacacctggcagtatctggagacacttttagttgtcacagctgggggtggtcggggactgctgttggcagctagtaggtggaggctgttaaacatcctacagtgcagaggacagcccccgacgatgaaggatgatgcagcccaaatggcaatcgtgcagggttcagagaccccggtttagaggaagtgacccacaaaaccataagaattattcataaacataaacagaacaatttacaatgacttataaacactgttcttggagactctcttcaactaaaatacactaatctaataagtttcaactgacagatttgaattataagtaactcttagaaattagcaaaacaatactggtcaattaagtctcaaggcttcaggcagagtttaatctatataaactcaaactttagggtcagccaaacctggcttcagttttctaatcctgccactaaccatgtgatcttgggaaaatgactttcctgtgctttagtgctgtctgtaaagggagaatacctgccatttactgggctgttacaaggacaacaaagagaaggtgcatccaactgaagctttgtacagggcgctggcacagcccagggctcagcctcacctctggagacatcttcacatttcaaactttcaaaggcagaaacctctttcttaacctcaaatccatcttaaggggtttgtagggttctcaagctcaaatctatcttaaggggtttgtaggggcctatgagctgcttgaaattattattaaaagtttgagtgcacatgcagttttctgaatccagtttttataaaaatctcaaaaaagtaatgaatcaccattctgaagggtgacaagaacacaaggaaaatccagtccagcactcccacaacactgaccttctttcaggtttccgctcaaaagctgcttgtgtctaaaaacaaaggtgtagaacacagcttggcaggctgagtaaaatggtccatggagagcaacatcgcagaatgcctttgttcccgaatcctggttattaaggtatatgtgcagccagttaaccaaaagatctaggcatgattttacagtactagagaaaagaaaaattcaagtcaactttacacatcataaaaaaaccagaataacataaaaacacacaactgcctttcattacaaaccatgctaagtaagttcataggtttctttaaataatacccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttaaggtgattggccaaacaggacacgttcaccaacacctctcaagagaaagacagtctggtggacttcagtattccctgatgcatcctagtcaagtcctatggtgaataattttgtggttggggaagggtttcaacagcatccttgtccaaaggtatctttatgggccactggaagaaactggcctcctagataggtctattacctttaaaagggtttttcttcagctttaacagatacaatagatttggaatgcaaatgaaaaaatgacaaacctacaaaaagaatcaaaacagtatacaacactgtcctctatccacaaaacaaatggatctttaagtgcaaccaaaagagatgacaaaagccttacatacagggttttatatataaaaaaggagacactttattctaaaatcaccacttagaaatataaacatcttgcacagagtagggattttattcactttaaaaacatgccaaaaaaaatgggagatatttctgacttgagacaatgctatactctttttaaagcatgatattaaaaagtattcggaaaattaggctacttacataagaggaataaatttagctcttgccaaaaagcttccaatataatttccagcagcctgcctgatgatggcaggattacttgggtcctgcaattttttccagagatgttccaaaaatgcctctgcgaatccctataaaaagagagggcgtcggtgtgatcttttttaatgcctaagataatctggctatcaaaatcccaagatttttacttcaccaatgtagggaaaagttctactatctcataactatctcatgggcttcatttttaaaacacattgagagaatatcattaaaaacaaaaggcacctcgggtgttaaataatccagtggatcccaaacctagctaagcatcacaatcaacccggggccaggcacagtggctcacgcctgtaatcccagcactttgggaggccgaggcgggtggatcacccaaggtcaggagctcgagaccagcctggccaacatggagaaaccctgtctctactaaaaatacaaaaattagccaggcatggtggcaggtgcctgtaatcccagctacttgggaggctgaggcaggagaatcgcttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattacaaaaactcttcaagtgattccaatgtcagccagaactggtgaccaacaataattcacatcccatggagctccacatgggcactcctgtgagtgcaaagcaccttccggtctctggacacactgaactcaaccacgaacagaaatacggactaacgcacagctggtatttgagttaattatgccaatcatggaaaaaaacagacacagcttctcaccaaagggtgtaacttccaacttctcctaaatagcgctgttctaaagctaggcacacccatgtgggcagactgaattcaaccttctttcccatgaccaacactctcctgatctctaggaagccacaaaatcgttgcagagaaggaaaagccttctacattctttcccccaccaaaaaaaaaaaaaaaagaagaagaagaagaaaagacaaagcctaaagtttttaaaattctagattaataagttggtttgggctagttacaactcaacccttggaaagaataaaggaaatacagttaattaccccatatgagattttaatagagaaaggcttaagggaagagcaccacctagtgaccaaaaggcaggatgacattttcggagcacctagctgggctggcaggcagcaatctgttttctctccaagtgtactgagaagggaacgtgggccaggcacagttgttcacacctgtaatcccaacgctttgcggggcaggaggcgggcagatcacttgtggtcaggagttcaagaccagtatggccaacgtggcgaaaccccacctcttctaaaaatacaaaaattagccaggcatggtaacctgtggtcccagctatcgagagggtaaggactgagagtccgttgagcccaagaggtggaggttgcagcagtgggcagcagagcgagactgtgtctcaaaaaagaaaggaaaagaaaacaaaaaaagaaaggagaatgcgattttattaagcagactagcaagtaagctcaaagaaaagaattatttacttcatggtctccgtccaccccagtttttagggaaaatttttgggcaaaaacaaagtaagctaagataatgttaatcacattcttactcaccaatttgaaactacagaggtaaaacatgaaaaactgtacatggcaggaggcatgggtgggcaacaggagtttgtcaaagatgtttatcaggtcgcgatatagatcctttgttttgccgttatcaaccttacctatggagaaaatctggcatctcagtttttataaagacatattttcaagtttcatctgccatattttttataaacacaacaccattaaaaaacaacattatccagccaagcacagtggctcctgcctgcaatcccagcactttgggaggccaaagtgagagggagcccgggagttcaagggcagcctggggaacacagggaagctctgtctctacaaaaaatcaaaaaattagccaggcatggtggcacgcctgtgatcccagctacatgggaggctgaggcggatgaaccgcttgagcccaggaggtcaaggctgcagtaagccatgtttgtgcgactgcattccagcctgggttagagtaagaccgtggctatttaaaaaaaaaagaaagacagacattatccattaaaataccattaaaacaaaatgctacttttagtttacacagattttcctctgaatataataatctaacacctgcaaggaagcaggccctcacctcacacactgtggcaaggtcagaaatgcaaacccttctgaagagcaattctatcattcgtgtagcaaaagacctctaatccgatcattttactgttagtaaacagctgaatatataggcacaagtatgttcattataactgttacttatcatggtgaaaacagtaaaagacagttaaacccatgtgaccaacaacatttattattacgacttttttttttagagatggggtcttgttatgttgcccaggatagttagtcttgaactcctggcctcagtgatcctcccaccttggcctaagtgctgggattcaataacaattattttaaaacaggcaatgatatgagaaaatgtttatcttcagcatccatgtaaagggcagattatgaaacacttgtgtttagtgtgacacccaaattcactaaaaaatactctcctacatatacagacgctaacagaaaagggaaaaaagtcaaacttcaaaatgctcacaatggttctctgaagagtagaaatgtggccatttaaattgtttttatcctttcctgtagtttccaaattctctaatcaacatgtattatttttataacagcaagaccgttaaaacagtaatgcagtcaactcagattccagttctattattctgactcactgagctcatcttaaatcttagcaatgtgaatggaaaaaaattctgttttcgcctggcaaagcctttaaagttccatgaagtcaagaagcacatatagtactaacactggcacaacaatggtgccaggcaaagaccctctaaactcaatacataacggagcaccatatattagtgcaccctacatcattcttcagtgcattcagcaacttgagcgtaatttgatctaaaactggccaaactccatatataatctttcaatacaacaatcagtgaaaagacagaagacaaatataactcagccagaatcccagtcccattttcaagctatgtgactggcaagtaacttgacctctttaaatcatcttaaactcatactcaatagatatttttacaggatttttagtattactagagataatggatggaaaatgcccagcacaaagccaggtacactgcaggtgttcaataaacagtagctactgtgatttaccatctacatagcagacatccttcatgtaggacaaaaccaaagacatcaggatgtccaggcgctcggctacaggatgcaccatctggtcgagccgttcaggaccagcctttgtttcatgttcagtttcttcatcttcatcctttgaagacaaaaagtaaatactaacattaaaaaattcaatgtcaaagtggtttagtaggaaaactgtcataagtgattatttcccttaaaagataaaacaaagaggctggggaaagcggctcacatctataagcccagcactttgggaagcagaggtggggggatcacttgaggtcaggagtttgagaccagcctggccaacatggtaaaactctgtctctactaaaaatacaagaattagccaggtatggtggtgcacgcctgtaattccagttactcaggaggcagaggcaggaaaatagcttgaactgggaggtggaggaggctacagtgagccgagttcgtgtgctccagcctgggcaacagaggaagactctgtgccccaccaaaaaaaaaaaaaaaaaactaaactaaaacaaagaaatggaccacgcacagtggctcacgcctataattaccaacactttgggaggccaaggcaggaggatcacttgagctcaggaacttgagaccagcctgggcaacacagtgagacctgtctctacaaaaatagaaaaaaagtagctgggtgcggtggtacactgtagtcccagctactcggggaggctgaggtgggcagatcacttgggcccaggaggtcgaggctggagtgggccaagatcacacactgccacactccagcctgggcaacagagtgagaccctgtctcaaattaaaaaagaaagaaaagaaagaaagaaatgcagacacctttccaggcaggggtctcattcagggatgtgaatcagaaccaccagtgaaatttaaaataaaagccaagactcacagcaccagcttctgattctcattgagaagacccaatgagacctatccatgcaaaaatcacagatgccccctacctctgctcctggtgcccaccatggcgggtgcttttggtgccgggcccccttttgcaggtcgggatatccacctccccactgctgtgagtactggcggccaatagctcacagccgcctactttctccagagctgccctgagcagaaaggagccaggaccacccttgcactctttccagcccctcccccttagaaccaatgactgattgacaaggcatcagaaaaggacatctccttggtctcaagctgggaacaaactctgtagaccaatccatgccccagaatgcctggtgggagcaggctgtagcgacctcccaagtgagacccggcccccgtttagctcccctgccctcttctgctccctgacaccctctgtcccaagggcacctgaatccctgtctcagactctccttccactgaacccaacttcagataccacccaaaagaagtaatgctataaagtgtacaagtggtaaaatgcagaaattaaacaggtatgcttttctattaaccacgccctcacagacagcatctggcttacaaaaacaaacactgaaagttacaagaacaaaagtgaaacatacttcaccaaacccaaattcaaagccttggaaatagaccaactatgctaagtgctaaatgacatggcagcaaattactcatataaggaatcgttttcaagtttgctgaactattttaattctttcaatctaaagccttaacaaagatgagcagcactagctgtttccaccctttatgataaacttcatctccactttcattaataaactgctaaccatattaaacaatccttccgtggaatctgtcccaccacaagtttgagttgctgtttcttcagcatcttcaataccctgccgggatgcattcacctataacaaagggagaaaaaaaaagaataaaaggatttaaaaaatacaactatgttattttgggatggaaattcatctgatatacgcatgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgccaggcagcctcaacaaattcaacatttattctagctctgatatggtctggctctgtgtccccacccaaatcacttttttttttttttttgaggcagagttttgctcttgttgcccaggctggaatacaatggcaagatctcggctcaccgcaaactccgccccccaggttcaagagattctcctgcctcagcctcccgagtagctgggattacagtcatgtgccactgtgcccagctaattttgtatttttagtagagatggggttactccatgttagtcaggctggtctcgaactcctgacctcaggtgatccaccggcctcagcttcccaaagtgctggaattacaggcatgagccaccgcgcctggccccaaatctcatcttgaatcgtactcctcctgtaagtcacacatgttgctggggggggactggtgggagataatttgaatcatagggtaggtttcccccatactgttctcgtgatagtgaataagtctcaagagatctgatggttttatcaggggtttccacttttacatcttcctcattttctcttgccgccaccatgtaagaagtgcctttcacctcccgccatgattctgaggcctccccagccatgtggaactgtaagtccaattaaacctcttttttggccaggtgcagtggctcacgcctgtaatccgagctctttgggaggccgaggtggacggatcatgaggtcaggagattgagaccatcctggctaacacggtgaaaccccatctctactaaaaatacaaaaaattagccgggcatggtggcatgtgcctgtaatcccagctaatcaggaggctgaggcaggagaactgcttgaaccccggaggtggaggttgcagtgagccgagatcgcaccactgcactccagcctgggcaagaagcgagacaccatctcaaacaaacaaacaaaaacatctctttttcttcccaggctcagctatgtctttatcagcagtgtgaaaatggactaatacaatctctatgcacaagacactcacagacacattgtgtaataaacatatcgtcaatcaactgagcagaaaaatgatgaactgccagccaaatgtgcatgatgcaatatttattttggtatatcaccattcaaatatcttaacataccactcaaaccatgccattttttattatctatgcttgaccttctttgtaaacattctaaaatgttccttaagtatataccagagaaagactataaagagtacatatacagttggccagagaggtgcaactccaagtgagcactgcaccagtgagcccaagctccagctcttctgagaccttgttccatcttcctgctttcctatagcatcaatgttttcctccaccaaagctcctctcccctcagtccacaaacctgctcacgtctctccactcctaaaccacgcctcttagccctgctccatcccctccttccaccacaaccctgcaccaaggtctctaacagccccaattctgcttccccaccatccacatcctctcccgaaatgcagtttctgcgtcttcactgacatggtcctccagaaagcaacaaagactaccttctaaccactaaatccaaggactgttgctcttttcatctttctaaaaaatgacagcagtatctgatgctgctgaccaaactcctccttccggcggatccttcctgagcatccaggctcttggttttccccatacttctgatcacccttctcctcccctgtcctaaactgcatctttccaaaggtttatgctcaggtccccatctgcagccacgactgcctgtgagtattctctggtaggctgcccaccagcaactgaacctggccaagatggaactactcttccaactgcctcctcttcgtatttttttctttttttttttttttttgagacagagtcttgctctgtcacccaggctggagcggagtggcgcaatctcggctcactgcaagctccacctcccggattcacaccattctcctgcctcagcctcccgagtagctgggactataggtgcccaccaccatacccggccaattttttgtatttttagtgagacagagtttcaccatgttagccaggatggtctcgatctcctgacctcgtgatccgcccgcctcggcctcccaaagtgctgggattacatgcgtgagccaccacgcccggcctcctcttcatatttctaactaccattaatggcaacaccaagattcaattccacagggagcaaagttgaaggattcctttcccttactgtctgcctcccctcctccaaaccagtctcaagcaccagttcatctttcctgacaatgtcactagaatctactacttcctttcattcccactgcaccttagtgcgggcctccttaaacaaagttttaactgtttataattataatctgcccttaagaaaggccaaacaggaaaaatcacttccgtaagaatcccttcctgaccccactgtgattctatcaggttctctaactcataatgtatgtttcattcatagcattttccacaaccatacttttacatttggataactatgtatttaacgccttgttctccaatcatgagaaggaactgtctacaactcccagcacatgcacacattcaaagaaaggaagcaaagaatggtgctagtggtttcttttcttttttttttttttgagatggagtctcgctctgtcgcccaggctggagtgcagtggcacgatctcagctcactgcaagatctgcctcccggattcaagcaattctcccacctcagcctcctgagtagctgggattacaggcacccaccatcatgcctggctaattttttatttgtatttttatagagacggggtttcgccatgttggccaggctggtctcgaactcctgacctcaggtgatctgcctgcctcggcctcccaaagtgctgggaatacaggcgtgagtcaccacgcctggccaagtggattcttttctatcactgactattgtttccacatactgtgattataacaaattcaagtcagtaaatgaaaataaaaatagattactcaatacttacatccaacttgagtagtttttcaataataagctccagaatttcatgcctcaaggttggaaaatatacactaatccttagtaagttatgaacgtaacattcctaaaggagaaaatgtaagataaaacatttcaacagagaataaacgtttcacagttatgtaagcaaaacatcaattacatgacctttagtttcaaatatttaaaaagaaaaaaacagactatccagcaatacaaaaactatactgtttctacatgtattatgttcggtataatcatttcaattattcccagtaaatgaaatttttaatttgcataactataggtttttaagtagctgtattgataaaactcatatatcatacaatcaccaacttaaagtatacaatttaagtttttaatatattcagttatgagaccatcaacataatcaatttcagaacatttatttttcttttagagacagggtcttgctctctctctcaggatggcgtacagtggtgcaatcatagctcactgcaaccctgaattcccaggataagcaatccttcctcctcagcctccctagtagctagaactacaggtgcacaccaccacatgaggttaatttttccttttagagagacattttctcactatgttgcccaggctggtcttcaactcctggatcttcccacttcagcctcctgaagtgctgtgattatgggcataagccactgcgcccagccagcaattttgtaacattttaatcacgctaaaaagaaatcctacatccattagtgcacccctaaaaaatgaagaccttggcaaccactagtctttctatgaatctgcctctttgacatttcatataaatggagtcatataatacatgtttttagggttcaatcatgttgtaacatgtaaaccattcctctcatatcaatggagtcatacacagtttgtggcatgtttttagggttcaatcatgttgtaacatgtaaaccattcctttcatatcaatggagtcatataatacacagtcttttggcatgtttttagggtccaatcatgttgtaacatataaagcattccttttcattgctgagtaatattccattgtaccatgttttgtctgttcatcagttgacagacatttgagttgcttctacttgaggctattatggatgatgctgctatgaccatccatgtacaagtttttctgtggacatatattttcatttctcttgggtataaacccagaaatggaactgctgagtcacgtgttaattctacatttaaccttgaagaaatgccaggctattttccaaaatggctgcaccattttacattctcacagcaacatatgacagttccaacttcccatttctccatatccttgtgaacacttgttactgtcttctcgttctgattatagccatccttgtgggcatgaagtgaaatcatttccctgatggctaatgatgttgagcttcttttcatgtgctttttttgcagaaatgcctattcagatcctttgcccacttcagttgggctatttgcccttttattattcaattataagagttctttacatatacaagtccattaccagacataaaatttagaaatatttcctcccattatttggggatccttttcatcttcttgaagatgtcctatgaagcataacaacgtttaattttgaagtacaattgatgcatttttttctttggttgcttgtgcttaggcatcaaatctggaaattactgcctaaaccaacatcatgaaaatgtactcgttttcttctcagagttttacagtttttactcttcatgtagggcttttattgagttcatttttaaatatggatatccatatgcttcattcttttgcatgttcatatccacttctgccagcagcatttgttgaaatgactattctcccctattcaattgtcttgaacaactggttagtgtatgttagtcttctgtcccgtaaccatgctgaactcatttattatctctaaaatttcttgtgtgtgtgtaaactccttagaatgacatataaaatcaccttgcaaaagagagtttacgccttcctttccatctggatgcttttaattctttttcttgcctaactgccttggctagacaagcagcaagagcggacatccttgttttgttctttgtcttaggaaaaaacttttggtctttcaccaatgaatatgatgttagctgtgggtttttcagatgccctttatcaggttgagaaaatttccttctgtttttctcgtaaaaggatattggtgtttgtcacacacttctgcatctactgagatgattatgtggtttttgtcctttgttctattgctacaaaatattttattaattcattttcaggtactaactcaatctcggccggtcacggtggttcacgcctctaatcccaacactttgcgaggtggagacgggtagatcgcttgaggtcaggagttcaagaccagtctggccaacgcggcaaaatcccatctctaccaaaaacacaaaaattagcggggtgtggtgccccatgtctatagtcccacctactcgggaggctgaggtgggagagtcacttgaaccctggaggcagaggctgcagcgagctgagatggtgccactgcactccagcctgggtgacagacggagactgtccccccacccctgaaaaaaaaaaaatcaatcttgcattcttaacatcagtcgcacttggtcatggtacataattctttttgtatgctactagattcggttttctactaaggcaaccactattaattattaaaaactgcacagatgatctgaacattgtacaaaaacttaagcagaattcttctatggaaggctttgtcttcaggttaaaataaggcatgttcacaattagtaatacatgaactattatcttctagtaattcttgtccatatgagcataaagccactacagatattcctgaaatgaactcagaccttgacttgcacatagtaataacagaaaaaggcactgggaatccccaatagccgctttataagaaaggaatctgagtcaaattcttagacgtcagtttaaagtctagaagacaaagtaacctttaagaaaaagacctaacattagctgggcacagtggttcactaatcccagcactttgggaggccgaggcaggcagatcacaaggtcaggcgttcgataccagtgtggccaatatggtgaaaccttgtctctactaaaaatacaaaaattagctgggcatggtggtaggcgcctgcagtcccagctaatggggaggctgaggcaggagaatcgcttgaacccgagaggcagaggttgcagtgagccaagatgacgccattgcactccagcttgggcgacagagtgagactcggtctcaaaaaagaaaaagaaaaagaaagactggaaaagaaagaaaaagacctaatatcatctaaaatgaaatcgtacaaacaacttttccatgatgttctcaatgaaaagatttcttaccagtgttctctctgattttcgaacaaatggaaatttttccaccagtattggcatgagaaaccacggtgtcctatttttaaaaaattaaatcaatccatgttaactttactttctagaaaaggaataaaaaggaaaactaccattctaaaagcaaatattgatagacataggaggcaaacaggaacccctacctcaaagaactggaactttttttgttttttgagacggagtttcgctcttgttgcccaggctggagtgcagtggcgcaatctcagctcactgcaacctccgcctcccaggttcaagcgattctcctgcctcaacctcccaaacagctgggattacaggcatgcgccaccatgcccagctaattttgtatttttagtagagacggggtttctccatgttggtcaggctggtctcgaactcccgacctcaggtgatccgcccgcctcggcctcccaaagtgctgggattacaggcgtgagccaccgcgcccggccagaactggaacttacaatgtatagcttctgagaaaatctataacgacttagagaaaataaggttctgttaactctgatatcaacagcaaatcaaagagggagcttctctcccacagaaacataacagcacttttgctgacatttcccactacacatgtatattatttttaaaagaagaaaaaatcatcaagttggattttttttaagttaacaaataatcaacggacagagggaactagaggtccacccctccaaaagaaacccacaaacctgaaaagcttttcttagaagtgcaatttttattcatatggcatgacacaaacacacccaggggtttctcactgaaaaattttggatagcatatctgttgaagataaaagcaaaattccaaccaccatacaaaattgggggaggatctgcatacaaactttgaaaaacaattaaagagaataaatagaaaatggaaatgccactttttgtagaatgtaatgtttcctcaagtggatacaaaaaaaacatgcaatgtaagactcaagctttaatactattaacattttataatttttactaattgattacaattttcttgagaattaaacattcaaaataaggaaaagtatactcacgatggtacatatcttgctattatttgcaaggctctgtgacatgtgtcaaaatttgcaggaagatctgaaaggagaaaagttcagagtatgagcatcaaaacaaaactgaagggcgacacgcttgaagctaaaaataaatgctggctgggcacagtggctcacgcctgtaatcccagcactttgggaggccgaggtgggtggatcacctgaggtcaggagttcgagaccagcctgaccaatatggtgaaaccccatctctactaaaaatacaaaaattagccaggcatggtggcaaatgcctgtagtcccatctactcaggaggctgaagcaggagaaccacttgaacctgggaggtgaaggctgcagcgaaccgagatcacaccactatactccagcctgggcaacagagcgagactctgtctcaaaaaacaaacaaacaaaaagtgacatacttgaagctaaaaacacatgctaaccaaaacggaataatttatcagagaaataataatttcaagatttttctccaccagcatcaacgaaaattaaatggactaattatataaataatgcattcaggacaaatgactgcatatcaatggtaaatataacaaaaagattacatcaaaggttgtcatttgttgcagtctacttattagaataggtgccaggtattctgtgctttacttttttttttaaagaagacagtgtcttgccaccaagcagggcttgaactcctgggctcaagcaatccacccacttaagcctcccaggtagctgtgactaaagacacacactaccctgcctagttctactttaagccttttttaagaaaatatttgaaaaaaaatgtttttttgcagagacaaggtctcactatgttgcccaggctggtctcaaactcttggcctcaagtgatcctcccgtcttggcttcccaaagtgctgggattatgggtgaaagctactgtgcccaggctttaaacctttttatacttactatcatcttcatcatcagaatctgaaacatctacatcgccttccttaatgatcactcgggcttttgagggaaaaagaaaatatgttattctgtcattgatctagacaatgaatggctatacaaaaaaagttactgacctagacaatgaacagctataaaaaaagttatttttccataatccaaagttagcccaatgattaattaaacgcacaatctgaaaaaaagtaaagcaactttatagtttttaaacggctaaaaattcctagatttcaccaggagttcaataaagcaaataaattcataaaactcacagcaacaaatgaatctagacacctccataggggtcattacggggaatatatgtctaccagacctggtgccaatatgcatctggaatcttccatggtagcagtctctcatatataaggggaaggtagtattttaataaagaagtattaaaaagaaaataaaattccaagcaatgacttacgaggcacaaaatgggaagcaatcatgctgagacacggtctgaggaaaacagtctgtgctgatacaagattaccaagaaaagccaaatactcttccactactgtttgacttctattcaaccaaggcaatctctagagtgggggaagaaagataaaagcagcatgttattaatataacatatactattaccaaagttctgaattacatactttacagtaaaataaatggtgaacttactaatataatactgataagttgctcaaagtcttttgtcaagtacatgatagaagaacggaattctagcagccagttgatgatctggtcatccttaagttaaacaaagagtactttcaaaatcacaaatcctctaacataacagaaatttacagctatcttatatcaatcatttatcaagaataggttggggggaaaaggtcacaaacttggaaggaactcaaaactgggtattaaaacagaaaaagatgtcacaataaattacttaactgttttaagaaagtaatctagtaactctaatacacaggagaaagacttaaatgcaatacttcagcctgatcacttctgtttgccctgaaaaagcgaaatcacctcaaatgttgacacctgggacttttaaaaactgcagcattctagcagactgaaatattagaagatcacaaaggaacaatagctacctctatttcctctatattcaagctgaccaggaagcatgctgataaaactcagtcgaggctgatcaattggggtcatgaataaacataacttttctaaaccaaacctgtggctgagtttaaatatattatgatgtgattgttctgtataaatgatagccccattcctccatgaaatatttttcgggcaatcaaattactgttcatagtaattgttagtgacatgagaagaactgctaaatttgaaacgcaatgtataaaatacagtgtcaattatgtaaaatattactatattaattatattcatgcatatatactgcacaggaaaaaaaccattaagaaaaagcccctaatttgtggaaggcttagacatataaataaaagcaacacaaggtcatacctacagggatattcatatggagttatcatttagtgagaatacaccatatgccaggcatggtgcctgacactccacatatatatcttcttctaatcctaaaaactctgcaagatgtttagttattcccattttgctgttcaggaagctgaggctaagaacgattaataagcaatctgcccaaccaagaggccagtaaagaagcaggtccaaacccgtctgtctcggtcaaggctatcctctgtccaccgtcccacacgcctccctatatgcggagaagaagctgtccccttttccccaccttaattcagctactgagtgcttactatgccatatccatgtgtcaaactcccacagatcaaccattttctgatgaaatcccaagtagcctggcagtaaaataaagtaaaaccacaactcatttgtactatggtaatttcatatgtccacaactgttaaggataacattaacggtagctcactaaggccaaaggcatgtagaaaacaagctaagttagtgtacaaataaaataaactatcctatctcttttccactaaaaagactgcaacaaaactataaggataacatttaaactgtaccatttttaaaagtaaatcaggctgggcgtggtagctcatgtctgtaatcccaacactttgggaggccgaggtgggtggatcacctgaggttgggagttcgagatgagcctaaccaacatggagaaaccccgtctctactaaaaatacaaaattagctgggcgtggtggtgcatgcccgtaatcccagctactcgggaggctgaggcaggagaattgcttaaaaaactcggaggcagaggttgcagtgagccaagatcatgccactgcactccagcctgggcaacaagagcaaaactccgtctcaaaaagaaaaaaaaaaagtaaatcagttgcagactttgatgctttagtactgaactattattatttctactagcaggcaggaacagtggctcatgcctgtaatcccagcacttttgggaggccaaggcaggaggagactgcttgagcccaggaatttgagaccagcctgggcaacatggggagacctcatctccagaaaaattagccaggcatggtagcacatgcttgtggtcccagatgctcgggagcctgaggtgggaagattgcttgagcctgggaggttgaggctgcagtgagccatgatcgggcccattacactccagcccgggtgacagagcaagaccctgtctcaagatggaaaaaagttctacttgcaacactccacacaactagtgcaattcttggtatgtcaaaataccaagaatgagaactgctgatacaaaatacagtggaacacaaagaaaatgtccctttgtatctgggaaagaaggcaggggtcaggaaaagctttaaagagaaagtgatgcttcagctgtctttaaacagtaacacagttgagtcttttctggaagttctgcttcttacagaaggaaaagtatgttttcagaaaactgaaaaacgttcagtatggcaggcatgtatagtgaccaagccaacagataataaatctggggaacaaagaagcaccaaatagaccatggggggccttgtaaaccagatctgtaactagagagatctggaagtgtgggaaatggactcaatgaaggaacaaccatgtgcttagagagaaccagggaaagctccatgaaagatggagcccagccaagagtggacatgctaagtttggagcatctatgatgattctgggtaaatgcatctaacagacagttaagaaacaagtctaggccgggtggagtggctcacgtctataatcccagcactttgggaggctgaggcgggtggatcacttgaggtcaggagttcgagagcagcctggccagcatggtgaaaccccaaatctactgaaaatacaaaaaaattagctgggcatggtggcacagctactcgggaggctgaggtgggaggatggcttgaacccaggaggcagaggttgcagtgagccaagatcatcccactacactacagcctaggtgacagagcaagactctgttctgcccgtccccaaaaacgaaaatgaaataagtctggagcccacaagagcaatcttggctacagacacaaatatattaggacacaggtagatttcaaagccatgaagggagatgaggagatcacacagaagaatcaacagagtgagaaaagagtcaagttttgaagcccaatcaacaccaaatttaagatcaagaaactatcaagaaatactagcgattaaaggatcactggccgggcgtggttactcacgcctctaatcccagcactttgggaggccaaggcgggcggatcacgaggtcagaagatcgagaccatcctggctaacatggtgaaaccccacctctactaaaaatacaaaaaattagctggcggtggtggcgggcgagtgtagtctcagctacttgggaggctgaggcaggagaatcgcttgaacccgggaggcggagcttgcagtgagccaagattgcgccactgcactccagcctgggcgacagagcaaaaaaaaaaaaaaaaaaaaaaaaacagattaaaggatcaggagacaggaggatcagaaacgctgaagttttaagaagtgggtggccaacagtgtcggctgatacaaggaatacaaggcttaaaaaagtaagtccactgaggctgggctcagtggctcacacttgtaatcccagcactttgggaggccaaggcgggcaggtcacctgaggtcaggagttcaagaccagcctggccaacatggtgaaaccccgtttctactaaaaataaaaaaaattaaccaggcatggtggcgggtgcctgtaatctcagctatttgggaggctgaggcaggagaattgcttgaacccaggaggcaaaggttgcagtgagcccagatcacaccactgcactccagcctgcgtggtaagaaggagactttgtcttaaaaaaaaagtccactgaaatcagcatgtaaaaaaaaaacatgggtaacctgtcagggtaattactacagtgataagaacagtggacttaaatgtgagtgagaaatgatacagcgcagtcagctggaacaaaaacaacagatgacaattattgcccttactttgagtcagagactgttctaagtgcttcttgcatattagctcattgaatccttgttaagtatttccatgtttaaagccaggcactttaaacatggcatgcacctatagtcccagctttttagaaggctgaagagaaaggatcatttgaggccaggagttcaaggctgtagtgcactatgatcacacctgtgaatagccagagcaacacagcaagaccacatctcttaaaaacaaaacactccatattttttaaatctctattgttttcttggtttcacacagtggaaaatagaggcagagaggttaaaacaatttgctcaagatcacacactggataataaaattggaatttcattccaggcaatctaactaccactgccatagtaataaaccattctcttcaaaactgggcagtaaaggaagaatggtgaaacaaaatgcattcagcttttactacatgataggtgtatctcgaacctggaaatgctgaatcagtggtttgttttttttttttttttgctttgttttagctttaaagagacaagagagttgcatgcagcatggaggaaagaggtagtaatctaatagaaaggaagcattagagcagggtttcccagcctcaacactgttgtcatttggggctggatcactcttggttctgggaggctgtcctgtgcactgtgagatgtttagcagcatctctgtcattcacccactagatgccagtagcaccctttcctcccagttgtgacaaaaatatctgcagccatcaccaaatgtcttctagggggtaaaactgtccctggttgagaaccaccagattaaaataagggaggaccatggagagagcaagttctggaggacagaatgggacccaaagagcaaactatgtctgtatacagtggcaataattttgctaatgatcaaacacaaaattaattacctttatgtctggatctaacagctggttcttcaacaactcaaagtcatttgtttcacccttaacaagaaggggaaagaattaagttatgcttttgtttcctgtttagtatcaacagcaagacttttaaccgtactttaacatcagatgaaattataaaaggaacactaactttcacatgtcaattgcggattataaaatcatgactacaaaaatttaaacactcatgttagtgcagccagagggcttggaaaaaggaaaatgataaactacatttagctatacttctgtattgacatttgaatataatagttgatactcctgcgaattctcaaaaagcatgagggaaaaaaacagccagctataatgatctaattcaggaggatctaaaaaagtattcactcaaatatggatacaaatggatattacatataaacatatggttacttaacattttccctctactgctgagatacagtagaaatgcttctaaactaccacaaaaacaaaaatccctactcagagaactggtttactgtcccaaagtaatgcttaggtaagttcctcaaaaaataaaatgctgtaggccaggcatggtggctcacgtctgtaatcccagcactttgggaggccaaggcgggtggatcacaaggtcaggagttcgagaccagcctggccaacatggtgaaaccctgcctctactaaaaaaataaaaaaattagccaggtgtggtggtgtgtgcctgtaaccccacctattcggaagactgaggcaggagaattgcttgaacctgggaggtggaggatgcagtgagccgaggtcacgccactgcactccagcctgggtgacagaggaagactccagcacaaataaataaataaataaaatggtgtaattgtttttaattctggcacttgctaaagttaaaagatgcttcgtaaataaagcatttgaagaggtgaaacctcagtaaagacattattactctctcattattacctgtgaaatgggccaaggtgggggaaaaaaaggacactattactctaattttgcactgacggcatcatgctattattaaatatttgatttcaactggtatcttaattaatcttgctatttctattggtctttagtataacagcaatagttgtattctgacctaaccaaaagcaaacctcacacattatctccccttacctttttgtacttcagcaagacttctgtcacagttccaccaaaccgaacagtttttcttgggggagaattgaaaaagtcattctctaatgcacgcatatttgaaatcctgtggaaccaagattaacaagctattaagttcatgaaaataataaaaattataatagccaacatttattgaaccaacataattcagtggaactattgttaaggcctctttactggtctccctgcttccactcttaaccaacaatccttcctttgctcagcaaccaataactgtcttcccactgcacttacagtaaaaatccaaatctctcagtgtggtctttaagatcctacattaatctggcccctgcctacctctctcacctcatctccaacaacttgttttactacagccataacgtcttttctgctcttcaaacaagccaagctgtttttcatttcacttactgttcactctattggaaatactcttttcccaaatctctacgtggctggatttttttttttgagatggagtcttgctctgctgcccaggctggagtgcagtggtgtgatcttggcttaactgcaacctccatctcccgggttcaagcaattatcctgcctcagcctcctgagtagctgggattacaggcacctgccaccatgcccggctgatttttgtattttcagtagagacgaggtttcgcacgttggccaggctggtctccaactcctgacttcagatgatccgcccgcctcggcctcccaaagtgctgggattacaggcgtgagcaaccgcgcccggcctagatttttgtcttcattcaagtggaagctcaaatgacagatgtcttcccaatgagaaatctcaaaagctccttctctcccttctccctcccccattaccttgttgtataactgaaatcatcgtgttcgtttatttattggcctatgtactgcctttcccccctatgctgtaagctctgtagaaagcagggacattagtgtctttggataaaccactgtccccagtgtttaacacagtaagcaggagctcgataattattatgaatcatattacgctaattgttttacaaggtttgcttcacttacacgtagtaaattaatgaaaaaacatagcatcctaatgactctgaaagttaaacgccaagagtgctacgggggttagggattttaaaagtggagcaaaataaagactgcgaaacaaatacgtgtgtcgaaacaaattccaaacaaaaaagatgtaatattcaatttgccatgagtgacgacgttcggctgataacccacatagcccagggaaatcccttccaaatttggacgaagaagagggaaggaagaggggtcaaggcgcagaaggcagtacccaggcctgggaaatcacgaagagacacagtcgggaaagggggcctccagaacagagaacatagtcacttttccaggccccacccatgtctattacccagttaggaggaatgagctcatttctgtgaacgtgagatgaccctccaccccgtgctcctatcacacgccatgagctttgtcccacatcctttcaatccgctcctctaagcgccgtcctgagctttcgtcccagatacgcagaaggaagcggcctgaatcttacccagtcctcgacgcgcccagcttcttaactgcagaggacgaagcggccgcatctcccggcaaacgcgtgtgaagcagcggtgccgccattgggccgaactaacgcgaccgctgcgcctcaggccggatgcccagctccttccagccacagcctctgtcccggaagttgcgcgtgccagcgcaaccttcagccaatcagcggccccgcgtggggagggcgtatgctctcggcgggctagagcgccgctgaaacccgctcctcgttctacttggaggacttgttccagccagcgctagtgcgtgagtataaggagagacgggaaggaccggctccatccagccctgaggatcccgaagaaagggtggaaacaccctggatgtgctaagctgtggccgggtacactcaagtgttaattttttggagtcaaagcctccctcagtcaaatcgaagaaactgaagcacttgtgactgacccagatcttcacggaggaaaggggattcgaacccggctgacccaggagcctgggctctatactcagtgcagcagtctcacagacacccaagataacgttatcctcacggaaacgagctcgacgaagtgacctacctcagagcctcaaggctatggtgatgctggcatgagaaacaacaggagagttacgaagaggtgttacccccttgactttatttatttatttatttattttcttttgaggccgagtcttgcccttttgcccaggtggagtgcagtggtgtgatctcagctcactgcaacctccgcctccccagttccagcaattctcgtgcctcagcctcccaagtagctgggattacaggcgcatgccaccacacccggctaattttcgtatttttagtggagacggggttgcactgtgttggccaggctggtctcgaactcatgacctcaggtcatccgcccgcctcggcctcccaaagtgctgggattacaagcatgagccaccacgcccggccaaacttaaatttttaaaagaggaacaggagtcagccagaccaacaaaagagccactggcgttccaagcataggaaacggaggaaacagaggccaaaacctcgggactgtggaggatgtagagggagagcaggggctgcccctactctcagggaggggaaaaggttgcaactttggaaactgtacaggcctatcaaaaatacaaaaatatccagcctgggtgacacggtgaaactccatctctacaaaaaatttaaaaaataaaaataataaaaattatctgggtgtggtggcacacacctgtagtcccagctactcgggaggctgaggattgcttgagcctgggagatagcaccactgcactcctgcttgggcaacagagtgagaccctgtctcgaaataaataaataagtttttaaaaatgcatatgtatgggcccggcgcagtggctcacgcctgttatcccaacactttgggaggccgaggcaagtggatcacctgaggccagaagtttgagaccagcctggccaacatgacaaaaccctgtctctactaaaaatacaaaattagccaggcatggtggcagtgcctgtaatcccagctacttgggaggccgaggcaggagaatagtttgaacccaggaggcagaggttgcagtgagccaagatcgtgccattgcactccagcctgggtgacgagtgaaactgtgtctcaaaaaaaaaaaaggtgtgtgtgtgtgtgtgtgtgtgtgtgtgtgtttatatgtatctctctccaggagttcaagaccagcctgggcaacatatggtggtgcatacctgtagtcccagctacttgaaaactgaggacggaggatcacttgagccctggaggtcaaggctgcagtgagctgtgattgtacccctgcactccagcctggacaacacagcaagaccctatttcacaacataaaatacagcaatttggtttttttgttttttgttttttttttgagacagagtctcgctctgtcacccaggctggagtacagtgtcatgatcttggctcactgcatcctctgcttcccaggttcaagcgattcttgtgcctcagcctccccagtagctaggattacaggcatgcgccaccatgcccagctaatttttgtatttttagtagagacagggtttcaccatgttggccaggctggtctcaaactcttgacctcaagtgatccgcccgccttggcatcccaaagtgctgggattacaggcatgagccaccacgccccgccagcagtttgttaaacataaaccatagctctgttttgcaacagtgtaaaatcagtaactgtctttcctgagtctctatttggtccttactgagttccttgggaatgttggacaggaatcatctgtgtctcaaggacagaggaaataattgcaccgtagctcacaaagatacttcaagataactgtttaaatgagaatctcttcttcacttccaagggaaagcaaagcaaaaacaaaaagcaacaatagcaaaacagcaatctgacaattatctgttttgttttgttttggtttgagacaggatctcattgtctagcccaagttagagcgcaatggcgcgatcatggctcgttgcagcctcgggctcctacagcttatgcaatcctctcacctcagccgcccgaacccacaccaccaagcccagctaattttttgtatttttggtaaatacgaggtctcactttgttgcccaggctggtcttgaacccccggcccaagtgatcctcccaccttggcctcccaaagtgtgtctccccacctacactcccattctttcccttaaaaaaagtctgagtctgggtgcagtgactcacacctgtaatgccagagctttgggaggctgaggcaggaggataacttgaagccaggagtttgagaccagcccaggcaacacagccagactccgtctctacaaataacacttttaaaaaacttacccaggcatggtggcacgtgcctgtagttccaattatttgggagacagaggtgggagaatcacttgaacccaggagttggaagctgcagtgagctatgactacaccacgacactctctggcctgggtgacaaagcaaaatctcatctcttaaaaaaaaaaagggaaaaaaagcttgatatgtacaaaataatatgttaatgtaagttataagaacataatgggccagacacagcggctcctgcctgtaatcccagcactttgggaggccgaggcaggcggatcacgaggtcaggagatcgagaccatcctggctaatgcggtgaaaccccgtctctactaaaaatacaaaaaaaaaaaaaaaaaaaaaaaatgtgccgggcgtggtggcaggcacttgtaatcccagctacttgggaagctgaggcaggagaatggcatgaacccgagaggtggagcttgcagtgagccgagatcgcgccactgcaccccagcctgggtgacagagtgagactccgtctccaaaaaaaaaaaaaagaacataatgaacacctgtgaacatatcgcccaatttaagaagccgaacattaactaggacaattgacacttactctgtgctgctctcggatcccaccttctacctgctttcctcccaaaaatagtcaccatcatgatttttaaaagtcattttagttttctttgaataattatcatatttatactcctaaacaatgcactatatttacttttatttgtctttgcattttataaagttatctccatgctgtattatactgctgtttgttttcaacattatgctttttttttttttttttttttgagacggagtctccctctgttgcccaggctggagtgcagtggcatgatctcccgccgtcctcccacctcggcctcccaaaatgctgagattataggcatgagccaccgcgaccagcctgaatattcttgtatcatgtcctgatgtatgtgtacaagtgtttttctagggtggaactgttgggttggagggggcaccaaaagcttttaggaaaggagaaaggaacaaattggatatctatgattttttttttttttttttgagacagagtctcactctgttgcccaggctggggtacagtggcacaagctcagctcactgcaacctctgcctcccgggttcaagcgattctcctgcctcagcctcctgagtagctgggactacatgtgcccgccaccacacctggctaatttttgtatttttagtagagatggggtttctccatgttgcccaggctggtctcaaatgcctgacctcaggtgatctgcctaccttgacctcctaaaatgctgggattacaggtgtgagccatcgtgtctggctactattagtttttctatttagaaattgttcatctggatcctccctacctttcagccatttgcaatacatttgttgagcataaagagtgaccttcttggccgggcatggtggctcacgcctgtaatcccagcacttttggaggccaaggtgggtggatcacctgaggtcgggagttcgagaccagcctgaccaacatggaaaaaccctgtctctactaaaaatacaaaattagcctggcatggtggcacatgcctgtaatcccagctacttgggaggctgaggcaggagaatcacttgaacctgggaggcagaggttgcagtgagccgagatcactgccattgcactccagcctaggcatcaaaactccctctcaaaaaaaaagagcaactttcttgtccacagcaaagaatcactggaagccatttgatgcaatatgacctcatctctctagccagtgtcgattgggttacaggagggcaccaagaagctttttgaaggctgtgccaatgtacacttccagcaatatcttcttaagcttgagtgcagctccttattttcccaaagcacagctaagactaaggctgccaagtttttaaaaagatttaaaggaaactctgagcattatacaagaaaaatactggccgggccctgtggctcatgcctgtaatccctgtactttgggaggctgaggcaggtggctcacttgagatcaggagttcaagaccagctgggccaacatggtgaaaccccatctctactaaaaatacgaattagcaggtgtggtggcaggtgcctgtaatcccagctacttgagaggctgaggctggagaattgcttgaacccaggaggcagaggttgcagtgagccaagatcgcaacactgcactccagcctgggcaacagagcaagacttggtctcaaaaaaaaaaaaaaaaaaaaaaaaaggagaaaaagaaaaccttaaaactaaatgcataatttctgttgtaattctttgaccatgtccgttctttgtggagcctctattcagtcaaattgtcctgtgggccaactcatcttggcaggataaaagcctccttatccagtcttgccttccccagagaaaataaagggggtgggggagggataaagaaaattaagaccctccccctccaaaaagagaaacaacaaaaagcatgcaaggattaacatgctatctgcaaagtcaccaccctgcccacagtgtggcctttcacttcactgagtaatatattgtttgtaatacaacaatgtaatcagcttcttcattccagaacaaaattttgctttactatcatcatatacccagaagacccattaaactgttatttcaaaacagcagcctttccttagagataaattttacagctacccctagagtagttctgttggccaaagcctcttagcttgctagtgaaagaaacaaagtcaagccagcttaagcagaaaaggagaatttgttctgaggatacaaatatatagtaaggtaccaaaaaagaatttatcattggccaatttggataaggtgccctcctgtaaccctcctgtaatctaatcaacactgttagagagatgaggtgacagtataccaaatggcttttgatgaatctttgctgtgaactagaagggattaagttatgctcaactaatggtttgcaaatggctgaatggtagggcggatccacacgaaaaatttctaaataacaaaaccaatagcatgtatctcatttgtcctttttcctttccaaagagtcaacaattattgtatgagtcaattatctttataaaaactacattcattaacacaaatgcaagatctcaactatatatctttagttatatacatgtatacacatatatgtgtatgtatacatacattatcctcaaagacaactaatttagagcgttcctcatcccagtatctcagagaaatacaaagcagtttcttagatttggcatcattgagattttgggccaaccagatacttctctgttgggtggggaggaggctgttctgtgaactgtgggatgttcagcagcatccctggcctctacccagtagatgacagtagcactcctctcctccccacagtaacattcaaaaatatctccagatgttgccaaatgtccctggggtacaaaactcttccaattaagaaccactggtataaacaagtcagctgggagtggtggcacacacctgtggtcccagctatatgggagggtgaggcaggagaattgcttgagccaggagcttgagaccagcctagccagaatctctgcctagcctaggcagatctctacagaaaaatacaaaaatcagccatagtgttggtgtgcacctgtagtcccggctactcaggaggctgagacgtgaggatcaattgagcccaggaggtcgagactgcagtgagctatgatctccccactgcatcctgcaacagggacgctatctcaaatagttaattaattaatggaagaaagaaagaaatcctagctttgtaatttactctattactttgggcaattgccttatgtttccagaacttcaattttcttatgtacaaaatgggaataactttttgagctattttagagctatcgtaaggattagagcacataaccacaaaccacaaaatatgtcacggtgtacaggacagggcaggttctccgtaaatgacagtatttgcccatttattttcctgtaaatatgaaatatactaggatacttgatgtggttacactcaggtggaaactgacctatgagggagatagacagataggcacggtcttttttgtttgtttgtttgttttttgagacggagtctcgctctttcacccaggacggactgcagtggcacgatctcggctcactgcaaactctgcctccaagatgcaaatgattgtcgtgcctcagcctcccaagtagctggaattacaggtgtgcactaccatgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcttggctcaccgcaacctccacctcctgggttcaagcgattctcctgcctcagcctcccgagtagctgggattacaggtgcgtgccaccatgcctggctaattttgtatttttggtagagacagggtttcgccatgttggtcaggctgctcttgaacgcctgaccttgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggaggaaatccaattttacgagagggtgtagcctggtgaggcctggatgacctccggaggcaggggcttgtgcctgggctgaggcctaagggtcaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaaaggaatcattacccaagacggggattttcagggaaacagcttagataaggccaggtgtacagtagctcccacctgtaatcccagcatttggtgaggctgaggtaggaggactgcttgagcctgggagttcgagaccagcctaggcaacatagtgagaccccatatccacaaaaaatttaaaaaaggagtttgtgttcctgtagtagcagacttgggaggttgaggtggcagtatcacttgagcccggaagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacgctgaagtgggaggatcgcttgagcccaggagttcaaggctgccgtgagctatgattgtgcctctgcagtccagcctgggcgacagagaaagaccctgtctcttaaaaaaaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgtggcaataaccactgcttccaagtctctatagaccaccccttgggtatatctaatgtaagtgatatttattttatttattttttgagtcagagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccgggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttcgttagtttcttcagattatcatccactgagggtggaaggggagtgagcagacacacttgggaggtgtcttgagattatcatccgctgagggtggagctgagggtggaaggggagtgagcagacacactcgggaggtgtcttgagattatcatccgctgagggtggagctgagggtggaaggggagtgagcagacactcggaggtgtcttgagattatcatccgctgagggtggaaggggatagagcagacactccgcaggtgtcttgaggctcagggagttatcagttatagaatgttgttgagttggaggaggtggctggtggcccatcctgttttttaaagtttcagctgtgaggtagggccagcagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcatatcacccttccactgagtactgccgacagctggggggtaaagaaaagtcactgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccattgtccacacatgttgcagcttctttttggagaatgttttccaggccctttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgttattacaaatacggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgatgcctgtaatcccagcactctgggagggcgaggtggatggatcacgaggtcaggagattgagaccatcctggctaatacagtgaaaccctgtctctactaaaaatacaaaaaattaggcgggcgtggtggcaggcacctgtaagcccagctactcgggaggctgaggcaggggaatcacttgaacctgggaggcggaggttgcagtgagccaagatcacgtcattgcactccagcctgggtgacacagcaagactccatctcagaaaaacaaaaacaaaaacaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttactgtgtttcacagggcagaaacagctgggcttataaacaggaatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtgctttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgattcaaagatcccccctgcaaccttcccacaaatgaaccaactgattctcacaagcaaagggagaatggacacctcccattgagggacaaaaaaaaaatcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgctggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgtcatgtcctgaaaataggtgacaactgcaaaccatccaccctggtgttgactgactttaacaaggttcagttcacagagattgagggcagaaaaaggaaatggcctcaaaagggtaagtttgctgtgttgccctcacaccacttgattcatggtcctgatcctaaggatctcacctgatacttggttttataggaaggatgtataaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccgtggcctttgtagggactgagcctgcaccgacgacctcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatgggcagcaaaatacaatgtaatatgaccaaaacatgaaagactgtgaaaatgaatctggaggtgacccaagcattgaattcaacaatccaggctgggtgcggtggctcacaccgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaatttaaaaaaaaaaaaaaaaggctgggtgtggtggctcacgcctctaatcccagcactttgggaggctgaggcgggtggattacctgaggtcagaagttcgagaccagcctggacaacatggtgaaaccccatctctagtaaaaatacaaaaattagctgggcgtggtggtgggcacctgtaatcccagctacttgggaggctgaggcaggagaattgcttgaacccaaaagacagtgagctgagattgtgccattgcactacagcctgggcaacacgagcaaagccccatctcaggaaaaaaaaaaaaagagagagagagacaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaaccttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagaaccataccttcctgtctacggcggttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggcggaggttgcagtgagcggagatcacaccactgcactccagcctgagcgacagaatgagactctgtcacacacacacacacacacacacacacacacaaaacacacaagaatgacgaggctggcatgttggctcactcccgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaagttgtgttgagctgagattgtgccattgcactccaacctgggcaacaaaattcaaactctgtctcaaaaaaaaaaaaaaaaaaataggccaggtgtggtagctcacgcctgtaatcctagcactttgggaggccgaggcgggtgaatcacaaggtcaagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaaggaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaactttacgcaaaacattctcactaatgactgaattcccaccaaatttccatattatcacagtatgcttttaatcttctcagatattaagtatttgttctcatcatagctaaaatgcaaagcaaatcccatctcagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatgggatttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacacaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaaaatttttttttttttttttttttgagacagagttctgctccactcagtcgcccaggctggagtgcagtggtgcaatctcggctcgctacaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtacaggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttctcatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacccaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaattttttttgttttttttttttttgagacagagttctgctccactcagtcgcccaggctggagtgcagtggtgcaatctcggctcgctgcaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtataggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaagaaaaaaaaaaaaaaattaccgaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaacaaaaaagtcatcaaaccagatgacacaaatcaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccgaaagagcagccacagcacccatctactcacacaggtggactgatggctgataaatcccagcaggagccaaaagagaagccaaaagagcagccaccgcacccgcatgtcctggtcctttcagggcgcccggaggtggccaggacagaggtggaggtggcttagggcaggggggagggaaggggacggggactgggcgggatctgagttggggagggggaggggaaggggaggggaaggggaggggaaggggggagtaagggaagggaaaggagaagggggctgttgggtacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaagaccaggtcctctctggaaccttcacaaacctgatttctggtccaccccaaccagctccctgtccctgcttctgggcgctccttccttcctgagctcccagggttcctcaaggtcacttttggtgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactggcctctcagggacgtccaaggaatctatgcatttcaagaaacaaagttcatcagcttctctcctaaggtgtttgcccacaatacccagagggcttggccgcatcatgtgtgatgggtggggagctccaagcaggtgggcaggacccaggggcctggtgaccaggacagacccccactgtccatcacctttcctggccctgtcctcagctaaacttcccacaggccttctgcccaatcacacagagtgtgcccaaactctctcaggcctctggcagctgaaaaccactgctttaaatccctttaccatttactatgacataaggttattgtaaacaggaaatattctattgatgctacaaatagaaagccaatgcctttaccataaatagaaaaacaaccctaagaaacaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtgtctaataaaatacaaaaattagccgggtgcggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaaccccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctaggggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctgctgcccggcaggtgtggggctcgggctcccagccacctgcaggacgacagcagtggtcagcgggcggcagctcagacctgctcaggacctggatgagaagccacctcctcagcagacaggacagagcccggtgccatctgacagaatgtcctagaatgctggatatatgggacatctgcaccgtccgtgatggcagcccctcgcgacgtgtgccactgaacacttgacagcagactggtgcagctaaggaacagagttttcaatttcatttttttttttcttagatggagtctcgctctgtcacccaggctggagtgcactggcgcaatctcagctcactgcaacctccacctcccgcgttcaggcgattgtcctggctcagcctcctgagtagctgggattacaggtgcctgccacgatgcccagctgattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgagcttttctttgtgggattttttttttttttttttggagatggagtcttgctccgttgcccaggctggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacggggtttcattgtgttggccaggctggtctcgaactcctgacctcaactgatctgcccgcctcggcctcccaaagtgttgggattacaggcgtgagccaccgtgcctggtcctttttaatgttttatatagatgtggtcttgctatgttgcccaggctggtctcaaactcctggactcagatccgcccacctcggcctcctgaagtgttgggattataggcgtgagccaccacacccggcccggccactgggaggtttctaagggactaactcggcctcttcacttgctatagacgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggctctgggcatggtgccgaggcccaggctccattcccagtactccccggtccccagccccagcccaccttgctccgggacatccagaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggcggccggtcccatatggagagccagatgtgcttgtcaaagaagccgcactgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcggccagcacctccttctccaccaggcccccgttggcctccgtctccaccgaaagccagtcattgaccaggaagaaggtgctgtgtgccgtctgcaggtccctgatgatgacgtgctgcaggaaccaggcagggctgagccctgcagaggcgcgggagggaggtcaggctcgcagggcgccccaacgcgggggcagaggggcagagcttggcagggtccgcacagacctttgtcgtgccacactcggatcttccacacgctacccaggctgtgcggggtggcgatccggaagatgtccaggctgttgcggtggaaggctctgtcgccatccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgaggttactgcaatttgtccaataaacagcaggacctcaaggacatgattaagttacatggaaagaactgtaacttgtgacatgcaaacatggctgcacacgcctcagtccacaccacaaccagtgacccgcactgcacacctgtccacgcctcagtcacgccacaaccagtgacccgcaccacacacccgtccctcagttcatgcatagactgcaaagcgtgaagctgtgtcacctcctctcccagtgacagacccaggtgacagtattttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaacacgccggcctaatttttttgtattttttagtagagacagggtttcaccgttagccaggatggtctcgatctcctgaccccgtgatttgcctgcctcggcctcccaaagtgctcggattacaggtgtgagccaccgcgcccggccgacagtttttaaaagtaggtaatcaaaagaaagaactgggaaatgaagataaaagcagcacggaaataaaaaatgggaacacggccaggtgtggtggctcacacctgtcatcccagcactctggcaggccgaggcaggcggatcacctgaggtcaggagttcgcctggctgacacggtgaaaaattaactgggtgtggtggcgtgcacctgtactcccagctactcaggagaatcgcttaaggggaatcgcttaaacccaggagctggaagttgctgtgagccaagatcacgccactgcactccagcctgggcaacagagcgagactccgtctccaaaaaaagaaaaacgaaaacaaaaagggaatgccagaagggcaattccaatgaaaggaaaatagaggtattgaagaaacagccacggggagggtgctggcgcctccgtctgagagacgagctatgcagtcaggatcgcgggtggatgcacggtctcccacagtggtagcgatgctcatgtcacttgtggggccacgctactgtgcagaatgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgtctgcgatgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcggccccggctggcatccaactggtccagcttgtgcaggatggcggccatgaccatgtaggtcaccaggcacacagcacatgtcagcatgacgatgtagtttacatccgctgtcggctcctgtgaggacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcacgaagaggctggcgccgaaggcggtgaggtggcgggtgaggcagacggcctggcggggcgaggtctcctccaggggcagcagcccctctgtccgccacaccacgtcctcctcgctgaagtactggcacagggacgtgtacaggcccacggacacctccagcgccgacaggcggaagtggctggagaggttcagacggtaactccccactgggtctctggtcctgggcagggaaggggcagtggacgtgagcccaggctccgccaggttggatatcggagtcccagagcccatacccggtccagtcccctcgctgcctgccgtccccacagggcctgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgtgctcattgggccggggctccgagtgcaggtagactgccaggtagggctcgggttcctcagacaggtagcggcctggggcagaacgcgcaggtcacacgcctgctgggaagctcaaccacccgggggacacccacgatggccctcctgagcccaccctctgccacgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgcctcacccgctgcacgcaccgtccagcagcgtatagttgagctgcagatgcagcacggccgcagggttgctgctgtccagggtgaccacagcaccgacggaggcctggggctggaccacaacggagttggcagagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttagccggggccctgctgaaagcctaggggatggagaagtggcagccaggccctggggcgccgccatagcacagcaggctccgcgggtccgagcgcttgccctgggccacgatctcctcgcccgccagtgtcaggggctcctcgttgagcacgcgggagcgcgtgaggatgcgcatgagggcagaggtcaggttgtaggcctgggacgccaccatccgcgatggtgactcggctcccagctctgagcgctgtggtgcccgcacgtctgagctggccaggtggatgaggtctcctgcagacagacgtgaggtcagtgcagagacagggaggcagagggagggtgggggcaggcaaaaagggggagccggagggtgggggctgggagaaagggggaacctgagggggcagagagcgaggtgcaggcagaagaaagggggaagctggagagagagtggtggaggggggagggggaaggggatggggatgaggacgaagatgagggggatgatggggagagggaggaaaaaggaaggaaaagggtagagaaaagagaaaggggagaagaggaggagcagggggataagggaggggaagggggataaggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaagggggaggggaggaagggggaggggaggggctaggggagggaggggctgggggaggagtggaggggctcagcgggaggaagtgaggggaaggtctaggggaggggaggaggagaagggctagcggaggggaggggagggggcaggggctaggggaggggggaggggcaaggggagggagggggaggggaggggttaggggagggaaggggcaggggaggggctaggggagggaagggggaggggaggggagagtggaaggcacagaacagcatcttcttagtccctccccacatctgggcccctctttacaccctgggtcccccgagaggcaccctgcgttcacacaggacagcagaaaggctgaggctactgaagcaggtcagagaccgaggaacgccatggcatgaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcaggcggcacagcaagctgtcagcagggcaggagaccggcaggaggccagcagatgcccacgactcccggggtgcagttacgtgctagatgctgtgtgatgtgggcattgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggataagccctccgcaaagctccaggcaggggtacaggtcttggtccccagcacgcatgcagcagatgtgaggtcccctgccaggctgcactcacctcgttcaggacggtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccatggcatcacgggagggctccgtgacgtcacagtcgggggatcccgctgctccccctaagcaggcctgtactcacccgtgcattcgaagtgcaccttggtggtgagggcgtgcacagcgcccagtgggaagaggcggcaagagccccccagcggcgggcggttgggggacagggggatggaggcgcagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaaggggtggtgagggggcgcaaccctctgccctgtcagccccacttctgcctgcaggccccgtcccctcggccatgggacccatccccagcccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctgacaggaggcaggcaatgctcactgagggcccctggggggatgcgtgtgggaacagacgtatgtgggggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccacgggctcagggtcaccaagcctcctggccggtccagagtggggagcgtgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacgtagaatttgcatcagaaacagagagggaagagcgcgcggcctccaccagcactaaaacacggaaaacagtagatgagcagggaggttgggctgtccaaggcaagtggccgaggggcgggcggcacccaccgtctggttggtggcctcctccttgcggccggccttccacacggtgaggctgaaggtgtactccacgccagccgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagcgcgggagaccccctccccatgctgggacggggcccaccaggcactgaggacgggccagccctggtggcaagctgggtgttctctgggctcatgggtgtggacgggtgaggggcatggaggacggccctgccacgcactgacctgtgtcgaagccacacaggcccactggaaactgagcggcgtctggtcgccatcctccaggttggggtcgtaggactcgctcccatccagcaccaggtcctgtgtgtctgaccacacgcggtatgagccaccctcagtgatgggcaccaggcgctcaggggccaccgtcacattggcctggatgctccgtgccagtggcgtgtccccaaatgacacgacaaacacaaagcagtagtgccccacaggcagcgccagccgcggcagcaccagctgaggccggctcacgtccacgccgggcagggccacacgcgccgggcaccccggctggtgggcccgagccagatgcagtgctcggctgtggctgggtgtggctccccgggcagccagttctggcagctctccaggctgaaggcctcgccctgcggcgctgggcccacctccacccgctgcacagtcgagaagccgatccacacgtctaggctcctgggggcgggtgtgggatgccagggggctcagggcactcctccatcctcccaccctcacagcagcccgctgggagccccatcactgtccccctttccagatggggaaactgaggctcagagcctggagagcagggcccaccaccccaggctcacagcagcacccacccacggggcctgtgggcaccggcagggatccccgcgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcacggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaatgagggtgtcaacggtcagtgtgggcccaagacgggggtaccaggctctgccccatctggatggccctggggaggaaggggagtgggcagcagacactcacctcgggccggctcctcgcccagggccacgatgctgtaggcagcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccaggggggcccctggggaggcagggaagacgtgctggaggagggtggggcccctacaggtgggggcaggaggcggcggggggccggagcagagggacaggcaggcgaaggaggcactagagggctgggccgccccacacaggcaccagccctgctccgagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacacccccatccgcccgccgcactcacaggctcccatgctgttcccttggcccggagcccccccccagagaggccttcctgagccctgcccagtgtctgcagggcccaggtcccacctggctgggaaggacagagctggccccacccaccggcactcaccacagccactgtccagcaaggggatgccaagcagaggctggccagccagggagtcaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacagaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaagaaggatcgcttgagccagggaggtcgaggctgcagtgagctatgactgtgccactgcagtccagcctgggcgacagagcaagacccggtctcgaaagaaaagaaagagaaagcaagaaaagaaagatggctgggcacggtggctcactcctgtaatcccagaactttgggaggccaaggtgggtggattatgagatcaagagatcgagaccatcctggccaacagggtgaaaccccatctctactaaaaatgcaaaaattaggtgggcgtggtggcgggagcctgttagtgccagccactctggaggctgaggcaggagaatcacgtgaacccgggaggcgaaggttgcagtgagccaagatcacgccactgcaatccagcctggtgacatagcgagactccatctcaaaaaaaaaaaaaaaaaaaaaaagaaaagaaagggaggagagagagaagaaaaggagaaggggaaagagccgggtgcaatggctcctgcctgtaatcccagcactttgggaggctgaggcgggcggatcacctgaggtcaggagttcaagaccagactgaccaacacggagacaccctgtctctaccaaaactacagaattagttgggcgtggtggcaagcacctgtaattccagctactcaggaggcttaggcaggagaatcacttgaacccgggaggcagaggttgcagtgagctgagatcgcgcccctgcactccagcaccccatcctgcaagagtgaagctccatctcaaaaaaaaaaaaaaaaaaaagaaaaaggacggagggcgagagggagggaggaaagaaagagaaaactccaaaaacaaaaaaagaaaaaccaggcaattaaaagaagcacaattggtcacagccatgggaaagacatcccatgtcagcagtcagtgaagaaaaggcaacagaaaccaaagggcggcagcatgtctctcttttcagagctgcccgagttacaaaccaggtcctggagctggtgatgtggaggtgagaagccagagagctggggcaaaccgagaactccacctcccctcggcctcaagcacctcgggggtcaccctgccgcccaccctgggcacccctcctggtcccacgcactcccagtagtgctcctggcacagggactgtggctccgcaggtctgcacaccacccccctgctccccaggaccccgagacctcacctcctgccacgggcctctacttccccaggtgtcaccctccccacgagtgacccagcaggtgcctctgcctagacttgctcttcccagcaatgaccacccggcagccaggcccaagccggggtggcctccatccctgagcacccgcccagcccctaccggcctccatccctgagcacccgcccagcccctgccagtccctgccaccctccatccctgagcacccgcccagcccctgccggcctccagccctgagcacccgcccagccctgccagcctccagccagccctgctcctcccaccggagctccgctcccgcagcagcctacccggcgcaggagagacgcacacacaggctgcctggtggggcccggggccagggcaagggcttgaaaagggaaccaacaaagaaggggaccagaggccaccccagctgaggggacagagcagccgaggccttctccgtgccaggaagcagccccagccacggacggtggagccgagccctcacctgggctgggcgcccagacagatgagacgctgggcactggctcccggagcttctcgttccatctgcggatggagggcacggttgggggtgcagttcccttcccccaggggctgtgggacactcagagagcctatgcctgtgccctgggctccgggaggggagaggatctgggggccaggcacacagggaacggcccctccggcagggccaccgcttcccccctaactgaaccctgcttctctgccgtcccctcctctacaccaaggtagggacacaggctgaggtgctccccactgcccataaggatgggtgggcccacagccacgctgctaggcatccacaccatccccgccgtggggtgggacagggtggcggctgggagaccagcaagaggccattcacgagacagggtgaggcagctggactcacacccgctgcccaagcaccatgcccgagggggaacactgtgctgtaaggaactgcagttagacctgaggagggacttttcagcggctgcggcggcagcagaaccaatgctttagggagaatgaggcaccaggacctgaggcgcagcagccctaaggggcgagaggtgctgcagaggccacggtgaacacaggcaggccccctggaagggacacagctgtgaaactgccccggggaggggcacaggcatggggagcagctcccacccaggccacgggagaaaggaaagaaggaaaagcctgaagatgtttggccacacctcattttctggaaaatccatcaagagtggctgctgctgggagctgacaagccagggcaggggtgggggcaggtcagccgaggaccccagagcccccccgctccccacccatcccactgtgaaccaggcctgggggtgccatggacacttcttccatgccagcaggcagccccgcctgtcaccggttctggccatgcactccctgcgtgccaggctccaggctggctccttctcccggccctcaccccagcccaaggcccacaaatgcagcaaggtcttggggaccccgctcggccgagctcccagggcccagggcagtggaatgaagctggggcccagacaggagccaggtgcagtcccccagcccccagggtgtggaagcgtctgccctgggtaggactcaggtgccccctgggtgtggaagcatctgccctgggcaggactcaggtgtgggcttcagggacagggaccagtacagggatccccgtggagtcctcaccccgcttgctcccgtacttttccacgtctgcatctgcttttgccatcgccgttctgggggaacgccaaggcctagccaggcagcctcgcgccagcccccccaccccgcccctcgggcttcctctgcacccgccaggtgacatcatcgccgctgtctgatgccctgcccccacgttctggttccctgcaaggatgggggacacagcagggcccaggcatctggcagcaggaccaccgagcggccctaagcccaggcaagagcacagagcagagtgcagggtcctctggggtcccaagcccttgctgccccacgcactcctcaccccagttcctgctataagctggaagggtgggagccaggtgcacagggacagcctgatgggtgcccgagggccaggatgtgctcccagggaagctgaagccaagcttgttgggagaagtacacccccatggggggcaggacggtgccccagccccgggacacaaggggcccccagcgccgagcgtccgatctggaaggcaggaggagttaggaccatcctagcgtgggacccagcgggctccttagcggctgctggggcaccactgggtggagaaggaagtcccaggtgtgtggccacagtacgggtcttcaccccttcccagcacccttgccaatcctggagcaggagcagcaacagcagagggtgtggccaggcctggaggctgcccctccacacccctgtcacaggtggggccacgtcccagggctgtgggcagcagggccagcctgccggcccgaggtatctgacacgtgtctcatgctgcagcgggtctgcccgccacccgggcgtgtgaaccccaggtcgggccccctcgccctggagcctcggcccctcaggggtgttcccagccaggcgctggctctcctgccctccccctgggctctgcccacagttggcgcgagggtgggtgaagcctgaggctggcagggcccgggaagtcttgtggctgggccttctgccccacaggcgctcctgggccgggggagccggggtcggggcgtgcaacagtgggactgagaacttccctgggtgtggggcagctcccggggccctcccaatccacaacagagggaatggccccagacaaaccagacctgcctcagagcctcacactcagagctgagtgccccaggcgcccatttcccagaccagatgctgagtggggtctgggggccggacggagcccccaaagaaacatctgcacattccagacgcgtgtggtcagcggcgggcgtgtgccaggcccggcacccctgcccgcgctggccgcctcactggaaactgggctggggggaccggctcggaggggccacctgcggagcttatgtaaccgctcctccctcggcaggggcaggacaggacgccagacccagggaggccccatgccccctgccaggccccgtcctctcctggaggagccggttcccctccgcccagcaagaggacccccaggcccgtccctcccgagagcaggcccagggtgaggaaatggggtgcagtgtgggcgctggagaggacaggggacaggcagcagtgccacccccactgtggccccttcctcgctgggccagccgagccatgacctcttctgtttccctctgcgctgtgctcctttctatttaaggagagtgaggcggcttccagggccggaaatgatcctgtttaaattaacaggctgcagtttgggacggtgctcatttgaaaaaaaacagtgcagccccgggctgggcagacggctgctggctccgcctaccacttccatggggagggccagggaggccggccacaaccctggccccacgaggggtgggggttgcagcctctgatagaggacgaggctgccaggccccaggcaacagagccctgcacgaggttctctgggtcccggacacggggtgtgagactagccggggagccccaggctcagcggcattctgtccttacagatccctcccatggctcaactgttcccaggatgagacgccgggggtgacatgggcagcctcaggtcctcccgggacccacaggcaggcacagggatggagactccggcctcggaggctgaacgagggagatgagaaaggggagtctgcgatgtccttgcctacacggatggaaaaacacagccagctcaaaaagggccgtttggagacaagcccacctgtgggtgtaggaaggagagcgcttcatacgtatgccacctgccgctggggtcggggccacccttccagttcaaggggagaatgagggccggctcctggtgcccctgcacacagctgacatggagccaggcgttgtgacccccttgcatccctctccactcccacccttcacagcctgggtgggcaggtgctgcactgaccttatgctcctgatgggcacagaggctcaagaggccctcctcctcccccaacaccatcccccaaacacctccccgggcagccagcagggtccagagtgtcaatggaggaagccaaggtaggaagagggtggtggggggggccaagcaaactggccatctgcgcccggctgtgcgggcacagcagtgccctggagagggcagcagcacagatccagcggggcagccggaatcccatcacccactcggctgtgggcacagccaatgatggcacgagccatcctgaggccagggccacgatgcacagtggacgggctcacaacccggagcccctgtactcccacagctgtgacgttccctgggcatgggcttgccccagcgctggcctcattcctgcctcaaccagaaggaagagctggcttccgcctctgcctgggcacaaagccctttccgaggtggcctgacagaagccagcctgtcttcagatcatggcgctgctaaggtcaggaacgccaggctgggccagggctgggccttgggagctgcagggagaaaaggacccagcccgcctcagccccagatgtagcccttctcctgccaccagtgcctgggcaccccggcccctaggcgaggacagctgccaagccatgaagagcgaggtgttctgggaaagggcgtgagctgcattttccagctgcgctcactctgcagggagactgtgacgcccccgccgctgtgcccgcagacgtgcccggcctcagccagctggagcgcaggcagcagagtgcaggccaggcccagacggcagcgggctgttttcattccagggtgcttggcgggctgggctgccgtggccactgcagagctccagaaaagaacacgtgtgtctccctccaaagtatgttcctcgctggaaagcagatcccaggcagggtctcccccacgagcagggggagaggcaccccaaggtgggggagcgagggcagtggcagaaccaccccataccctaggggacccagggaggggcttgcagatgcgggacccacatttggcagcggtgcccggccactgtcacgagatggtggccagcgcatcacccacacgtgggccaggatggcagaggagatccacagagatggctccagcaggaggccctcacagagatgccctggcctcagaagagccaacagaaagccgggaagggggacgtcgaggctcaagcttggcacaacctccccaaagctcccaaaggctcttggtgcccaccagcgacagcgcacaccgccaccacctaacagcaaggatgcagcagggtccgcacgtcagggcgggcactgagcggaactcaggcagtgccactcgccagcttacgtcaaaagaacaaaaggagtgaggacgatactcgcggctctgccaatacttcccagccccgcacgtctcacacacaccagaacgcgtcaaaaggcaccaatgggcaaacacccagaggtaggcacaagcaggagtaggccgggtcttgtgagcccctacagccacgcggccctgcgctgaaggcaccgaggctgggtgctgaggggtccataagagtccacccgcccaggctgcactggctcccgtcgtccagtgtccggtctaagcacaggcacagtgtctggctctcaccctcaggctgttacactctgctctgtggcagggcaggtctcacagtgcatggaggacaggggaatgggcccccggaacccctgagggaaccgacagagctactttaacaaggtatgattgttggggctgccagtggctgagccaggtcactgctacactgccctgcagggtgcatctaatcatggagcccactttacaggtgaggaaactgaggctgagagactggaccaaggtcacaccagaagtggaggcgctgggacgtgaacccaagtctgactccagggcgcaaattccctacatctgggttcccagcctccttcctgaaactgaacaggaaactacagggaagggacacagcagggatgagccagggagggagaggtgggaggggctggcagggagggagaggtgggaggggctggcagggagggagaggtgggaggggctggcagggagggagaggtgggaggggctggcagcacccaagcagctgcacctgggtgcagggcccctcagcccctcggggagtgcaagcacatcccagcccgactcggaagcgccactgccacctctgtctgtctataaaccagggcactagtgtgggccccaggcaccctgtgcggctgcaggggtctgccccagagcatgctgatgaaatcatcaccacggcttctcagagcctcaatttcctggtctgtaaaatgagaccaggagtggctgcaaccctgcagtgccgtgatgagctatggagagacaagaacacagagggctcagcgcagggcccggcgtggccaccgcggggagagggtgcggactcttcctagaccttttctttttgagacagagtttcactctgtctcccaggctggagtgcaatggtgcaatcttgcctcactgcaacctctgcctcccaggttcaagcgattctcctgcctcagcccccaaagtagctgagactacaggcatgcgccaccatgctcagcatttttttgtttttttgagacagagtctcgctctgttgaccaggctagagtgcagtggtgtgatattggctcactgcaacctccgcctcccgggttcaagtgattctcctgcctcagcctcctaattagctgggattacaggcgcccaccaccacacctcgctaatttttgtatttttagtagaacgggtttcaccatgttggtcaggctggtcacaaattcctgaccttgtgatccccccaccttggcctcccaaagtgctgagattacaggcgtgaaccaccgcgcccaccctgtttttttgttttgttttttttttaaagaccgtttcctagtcacccaggctggagtgcagtggcaccatcacagctaactgcagtctcaacctcatagactcagggaatcctcccccctcagcctcccaactagctgggactacaggcgccaccactaatatctatttattggtctcgctatgttgcccaggctggcctcaaactcctggcctcaagccatctgctctcctaaagtgctgggattacaggcgtgaggcaccgcgcccggctggacagtggttttgatttccgtttccctcatgactaatgaggccgaccatcttctcacacgctgttggccatctgtgcatcttctttggagaaatctctgttcagatcctgtgatttttttttttttttttttttttttttttttgagacagggtcttgctctgtgacccagcctggagtgcagtggtgtgatcacagctcactgcagccttgacctcctcggctcaagtgatgtcccacctcagtctcttgaatagctgggaccacagatgcacaccaccacgcccggccaatgttcttttattttttagagaccggggtctcaccctgttgcccaggctggtgtcaaactcctgggctcaagcgatccacccaccctggcctcccaaactgctgggattccaggcgtgagtgaccccttgtccatgtttaaacggggtccctgtctgttgttgaatcatagtgttccctgtatgatctggatgcaagccgatactgcatggatgacctgcaggtgctctctgtctccacagtcgcctctgcagtgggcgctcgggtgccccacattcccaactgctacagacacaaccaaagcctccccatcccttcccccacccctgccggcaatcgcgtacaggagtgagcgtgtgacttcttgtccacatttttgtccacaagtttggcgagtttgcatccgtgtctaataaagaaactaccgtttctcacgcaggcacgttctgaacgcccgagtgcgggagccacgtaagacccggctcagggaccccgggtgaggccagctgcacatgcaggatgcaggtcctcaccactgcctccgctcggctgccagggctcttcctagaagacacgggcctctcctaggctctcctgactgaggccctacccctgcccccgagtcaccttgccccttggggactctctctgggcagctccctgtgggagctttgaaacctggcttcaatgtcacctgcactgggggtccttccaggccagccccctccccatcatccatctctgtccttggagaatcatctgcgtgtttgttgaacgcgggctccagtgataacggagccctcgagggtggccctccttctgctgagggctcatggaggccttggtgacaatccctagtccttgctctcaggatccagggaccagaaatgggagccaggggcccctccgtggcctggccagccccccaaggaagctgtgtctgtggcagttgcgctctaaggcatcaggcctaggggtcgctccagaatgactgtcttccccgacgccaatcccaggcaggggccccggggtctgcgcctgctgtccctacactctcccacactctcctgtcattcagggatgcaggtgggaaagggcaaggccctgggtgctcctatattttacatcagtgaaccaagcacctaccaagtccctcgatgtgcccagtcctggaccccagcatttgcgagacagcagcagacccaggtgacccccagccagggtgagtggcaaccagcaccagaagtggcctttagagcagggggccctgagctgatgacatctacacctaggtcactgccagccaggacaacctctgggacaatgggatgtcggctccaacgaccaatttacaagaaacacaaaggacacactcacagcaccacggaggagacaccatggaggtggcacccccaagacacagcgagaaatccaggctgcaggagccagtttcttcaacaaattgcacaaggaaaaagagaggaagggaagctcctagacatcatcggacatttaaaagacaggcggtggctcaagcctgtaatcccagcactttgggaggctgaggcgggtggatcacgaggtcaggagatccagaccatcctggctaacacggtgaaaccccgtctctactaaaaatacaaaaaattagctgggcatggtggcgggcaccagtccaggctactcaggaggctgaggcaggagaatggcgtgaacccaggcggcggagcttgcagtgagccgagatggcactgctgcactccagcctgggcaacagagtgagactccatctcaaataacaataaataaataaataaataaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagccgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcgcttgcaccagggagtcggaggttgcggcgagctgagatcatgccactgcactgcggcctggagacaagagcaagactccgtctcaaaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcagtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatagaaaattagccaggaatggtggtgcacgcctgtaatcccagctactcgggaggctgaggcaggaaaagcgcttgaacccaggaggcggaggttgccatgagccgagatcgtgccgttgcactccagccttggcaacaagagtgaactctgtctcaaaaaaaaaaaaaaaaaaaaaaacacatgggtcaggaggggaagggtcggggcagggagggcagggcaggctctggggtggggggtctgtgagtcagccacagctctgcccacgtctccccacggagcttcgagccacgcagagcagcacgttttgcagtacgccatcttttccaaaagccaccacctctcggcagcatcattaacccaaggcaggctgtggcctcagaagccccggctgtcctccacctggaactggacacagctgtccctgctgagcttcagcagccagggagccacaagtggagaggcacctgcgtgagctccccaggaaggctactggtgacacccagacagcaacgctcctggacccttaaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggctccgctgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccacccaatgtttagcaagcctggggatgtgccacgtcccccagggatccagcacgcacccaaggagacactgtcccggcgaggagcctggagcctgggaaatacaaggcatcagactggtcccaagactctccccagcgctggggacaactgtctgcttatcttagtcccctgcgcccttttcaatccaaccctgggtcctgggcacctcatagttccaaatccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcatggtctttgctcacaccgttcaccccccttcttctggacccacctcatcgccccttcctaagcatcagcccaattcttgcacatccatcaaatccttgtccagacacctcctggaactcttccctgcagccccctacaaccatccccacctctccgggtaccccgcagccccaggccgcatcccaattcctctccaattagcgactgtttgtcctcccagctgagcgggcctccgggccccgcccccgctggcgtctgcacagcccccgggtgggacgtctgtctccagacccggggtttttcggctcccccgggccgtgccaaccgcggctccaggcgttccttatttagcagggccgctgtgcccgcgccggagcctcgccctgggagcgtcctggcccgcgtcctgcttcccgtcccgggccagggaacgcgcccacacccgcccgtcccgcggcctctcccgggtgccgctgggcccgctactcacagcgctgtggcgtccgcggggatgcgcagcgcgggaccgagcgtccgcagcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcagacggcatggcgggcgcggggctggatggggctgcggccgcgacctgctgctgagcgacgcccgctcgaggctcggggccaggccgctccgggagcttggccgcccgctcggacgctggcgctgcagtgcgagccccgccgcggctcctcctcctccccgcgccgcgcggggcggacggggcgcggtgggggcggggcgggtgcaggctccgcccccttcgccacagcgcgaccaggccagcgatgagggactggcatccggaggcttcaccctccgctccacagggtcggcagcagagcggggcctccggaagctccgccccacgcgttcccggggcgcatgcgacgtggggcggagcgtctggaagctccgcccgtcgcactggagagtcggccgaggcgcacgaggtatttttcacgctccgccccactgcaggctaaagtgcgtgggcgggaagcggtgggcagggtgccatctggctccgcccttctcctgtggtgtgggccaggcggcgggttcctcctcctgcagcagccacaggctccaccctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagaaggagagagggggaagagagagaacaggcaatgggaggttgatggtgagagcttattgaaagacaagagggaggaaacccacatcctccattccccatccattcatttattgccttatttattccattgaatcttcacagctctagaaaaagtgtgctacaattattccctttattaaatgaggtcactgaggcacagtttaagaaatttgccagcagggcacagtgggtcactccggtaatcccagaactttgagagggggaggaaggtggatcccttgagcccaggagttggagaccagcctggccaacatggcgagaccccgtttctacaaaaattagccaaaattagccaaactggctcacacttgtagtcccaggtactcgagaggctgaggccggaggagcgtgtgagcccaggaggcagtggctgcgctgagccgtgattgtgccactgcactccagcctgggcaacagagtaagaccctgtctcgaaaaaaaaaaaatggaaaaaagaaaaaaagaactggctgggagtggtggctcatgcctgtaatcccagcactttgggaggccgaggtgggtggatcacctgaggtcaggagtttgagaccaacctgaccaacaaggtgaaatcccatttctactaaaaatacaaaaattagccaggcgtggtggcaggtgcctgtagtcccagctactagggaggctgagacaggagaatagcttgaacctgggaggcagaggttgcagtgagccgagattgcaccactgcactccagactgggcaatacagtgagactccgtctcaaaaacaaaaaaaatcctaccacatgtgctccaccaagctctgtctccaaggtggccttggaagccacatggggaaggtggcagagactctaggagcctgagcagagacccagatgattatgaaaaatgcagacctacccatccttattcacctgggaccaccgtgaactatatcataagaaataaacccctattgtacatacatgcaccattccagttgggtctatttgttacagcagtttagccaaccctaatccacatatacagtgtcaacagtggctgagatgacatgttgcacagacatgagagtcagaaagacctgagttcaagtcccagtgatgacatttactatctgtgtgaccttgaaaagctgcctaactactctcagaccgtttcctcatcagtttgttttgagaatcaaatgagaaaattactaaaaagcccttagcactgcatctaagatggggaagagacagtcaatgaattcaagtttcctgaagcccagttgcatccctgccctgtcctgggctctgagagacagttgccgaagctagtgttaaagtgaactaaatatggcctgagtgggacttcgtacttctatagttgagtccttgtggacaaattgcaacctagcttaataggtagacaagattgaaaacctaacttaggagtatgcgtctgtaacaatagctgagtcttggccaatcccagaggccgtagttcaaccgctcatacgctgctgagtgttcaaactgtactcaaataaggcaaacgccaacttgtaacaatccagccattctgtacttcacttctgatttctgtacatcatttcccttcttttgtccataaatcttcttccaccacgtggctgcgctggagtctctatgaatctgctgtgattctggggtctgcccaattcgcaaatcattcattgctcaattaaactactttaaatttaattcagctgagattttcttttatcactaatttgagctggttttctaatgtttgcaaatgggagggctgactaatataacactgctccaaatattaacgtctttctcccaacccatcacccaggcagaagtggtccagcctggggaaccctaggaggaggctagctctcctctaggaaggcttaggatgcagccagtgggcagtaactggctcactgtcccctgcaactgaaatcagaactggttccagaaaccaagttgacccccaaccagtctttcccaaaatatggctctatgcccatctctggtcaggctgggctgttttcctggacagagaagtctcagacaagcaggcagtggttagtgggctgtgcccaggctgagaacatttcccagagcagatggcatctctggcagtcccttaaagccagcagaggccaagtcatgtccaagaggccaaaagacccaatatggtggagacagtctacagtccccatgaataagggatgccgatgccttccctatgtaccaggtagtcactgcctgaggggcccagagcagcaggagggcagagccagcctgggcaggggcactgggccggaagtggggctcacatcctcagcgcgcacacacactctcacacacacacacacacacacacacacgaatgcacgcatgcacacacaaatgcacgcacgcacaggtgcattcaaacatcacatacacgtgtacattccttgcaaagtcaacttctgctgatagcacaacaaacaatggggccacagtgtggcatggaggaaaccctggagtctgatctcatttttttttttttttgcatctgtcaggagataaagatatttgataaaaatccttgagtcacatccccaccaggtccctgcctacctgtagaccccatcaagccagctccatggcccctcagataccgcctcactgggtccccagggattgacctcagtcctggaaatgcagaaatatctgtatctgtcacagctgagactggcggccttccgccggctttcctggaggcagaggtggagacagggacttgggtggatgtggtttttgtttttgttttgaaaggggctttcaggagaagggaggtgaggactacaggatgcagaaggggacagagcagagtgagaatgtggtcccttaaagtcccgccttgacctatcccacgagcagcagagagcacgccacaggatcgtccccaccgtggggcagggaccagccattcacgttgctgtatcagttagtcactgggccattactgggcatggcatcccatcccaggcaacgtggctcccatctgagggtgattctctagagaaggacagctgtgagctctcagcaggtgaggctccaaaagcagctatgccagtctagacctcaggggaagggggaattcatctctaggcagggatgattttcataacattgaactcttgacatgcaggagcaccgaccaatcagaacagacacggtgaccaaacaggcacagccacaccagtggataccagcggaatgtccacgctgcctctgcgaagggacagtcccatgagccaagccctagaccagctgttctgggagcactgcatcattgcactgaattctcacaaccgccccataatgctgggaccatccccattttcctgcccaacagcctccgtctcatagacactaggcggctctcccagggtcacacggtccagtcaataacgggcagaactcgcactccgatctgtctggctccaaagctgctaaaaattttctacttggcctcactggcttgacaaagattaaaaaagaaggcaagtccttctttccaagagatgctgaggtccctcggcgacgctaggtcatgattttatcatgttcagagggcaatgaaagggacagaaaacaagcgatgtgtgatctcctgtcatgtcaagagacgctgatttcaaagaaacgtacgtttcgcagaatcaatacgctgtggggcctcagaaagctgaggcagacacacggccccgacccgtgcacgtgggagccctgttacaagagacggcagaaattaaactgaatcacctggagcaagtacattgtaaatgttcaatattaatgacccacctcggccccaaagaagagagcgttgggctttgtccagctgtgtgctctgttgttaaaagaccaccttgtggccaggcacggtggctcgcacctgtaatcccagcgctttgggaggccaaagcaggtggatcacctgcggtcaggagttcgagaccagcctggccaacatagtgaaaccccgttgctactaaaaatacaaaaatttgctggatgtggtggctggcgcctgtaatcctagctactcgggaggttgaggcaggagaatcgcttgaacctgggaggcggaggttgcagtgagccaagatcacgccattgcactccagcctgggcgacaagagtgaaactccgtctcaaaaacaaacaaacaaacaaacaacaacagaaaacaatttgtgccttaatgggcattcctttcccttcttgctaagggatgagatgatggcagaacttgtggccactgtcctggaggttgacaagctttttctgtaaagtgctagataataaatattttgtgggccacacgatctctggtgcaactacacaacgctgccattgtcatgcaaatgtagccatagatgatgataaatgaatgggtgtgactgtgttccaataaaactttatttataaaacagacagcaggccagagttgggcaatgggcagtagtttgccccacactccccgcccatccgtcctattccttggcttttttgggtacatcaaggagtgcaatctggatgctgggctattttatggccactgggcataaccttaacctgggccttttgtctgttaacctgggtcagtggctacggtgaaggtcgggcaaccaaggtttagatggctcagtacacattcacgcccacaaaccaaaccaggaaaaagatgtgctaagttgagcatatgacactgttggtactcaaatggtttgtttttttttttaaataaatgtttaagtaaattttttattttagaacagttttagaaaaatggtgaaagcagtacagagagtttccatgtaccccatagcttgatgcattatgaactaaagtccatactttttttgggggggtggggacagggtcttgctcgtcacctaggctggagtgtggtggtgtgatcatagttcatggcagcctcaaccctcgacctcccctggctcaagtgatcctccatctcagcctcccaagtagctggaaatacaggtgcctgccaccatccccagagaatttgtttttgtttgtttgtttgtttgttgtttgtttgttgagacagggtctcactctcattgcccatgctggtatacagtggcacaatcacgggtcacttgcagccttgacttcccggactcaagtgatcctcccatctcagcctcccgagtagctaggactacaggtgcacaccacaagcctggctaattttttgtattttttgtagagatggggtttcgccatgtcgcccaggctggtcttgaactcctgggctcaacccatccgccggcctcggccccacaaagtgctagggttacaggcgcgagccaccgtgcctggccacctgaagtccatagttgattctgattgccttagtttttgcttaatgtcctttttctgttccaggataccacatggagcattttgaggagtgctggtcaggtattttgtagaatgttcctcaactgggatttggcagatgcttttctcatccttagtcttggcttgtgtgtgttttgaggagaaggaccacagagcttaagaatcattctcagcactctgtatcaggcacgcattctctcaagatgacttgccgctattgatgttgactttgatcacctggctgaggtagtgtctgtccgtgttctccactgtaaagttactctctcctctcttttcacactgtactctttggaagagagtcactatgcacagcccacacttaggatgtgggaagtccgctccacctccttgacgatggaatagctatataaattacctggggccgggcacggcggctcacacctgtcatcccagcacttgaatgggaggccgaggagggtgatcgcttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaattaaataaaaataaataaataaataatctggaattcttctgcctgggagatttgtctcttctctcttatctgatcatttatagcagtatggaatcatggtatttattctttgaattctaatctgttacgtatttatgacagtatcagtaaaagcctcccttgaaatttaccaatggcatgaacatttcagatgagtctgccatctttggtgctcctgggacacgagagagacctgtcttgcttgctgatcacaaaggtggctttttctgtggccaaagctaaggctgtagggtctggtaagaagaaaagatggtcatgttcctcgtcaagtttccagttggctactggagagatcagtcaaagagtacaacaatcaatcattcgttcattcaaaacttaagtgcctcctatatgccaggtcctgtgctatggaagcaggattttgattagaccttttaaaatgggaagcaacaagaaaagggagaaagtcttatctttgatttcagcctaaccaagggaggcatcactgtttccttcttcttttttctttttcagaacgacgtcctatattactccctgacaggggtgaggagtgtttcctacagttcacaggaaagattatgcatccatgattccagtccctaggcttggaagagaggtctgcataattgagatacagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaacaaacaaacaagtaactgagttctcttactagaaaataattgtaaagtaacgtacaagtttgatattttctacacatggagttttaaatatgaagcagatatgaaggtatagtaaatagatcaaattatttaaagcaacatgtttaaactttcaaataaaacttaaacagaatcagtagtgttcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctatggagagagaatttcagaacggtatcaatggcctccaaaatatccctgccatttgactatattctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacagttttgaaatacacattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggatgagtatgttaattgacctgatttaattattccacaatgtatgcacatatcataacatcccattgtaccccataaatatatgtacttatttgccgattgaaaatgtttttaaatataagatgcagaagaatgtgtgctatcttttaaattttatggcatatggatgtattaactttttaaaaatttaaaagcaatatgtcaaactatttatagagtagaatccaatgatctatgtgggaataagaaagtgtgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatatggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgtctttagaatagcttggtcctgttcactcatattttttcttttctttttttttttcttagagatggggtcttactctgtcacccagactggggtccagaggcatgatcatagctcactgcagccttgaaccctgggctgcagcaatctttttaccccagccttccaagtagctgggactacagacatgtgctaccatgcccagctaattttttttttttttttttttttggtctacagacagggtctcaccatatcgcccaggctggtcttgaactcctagcctcaagcaatactcccatgtcagcctcccaaagtgttgtgataagaggcatgagccaatgggcctagactcacttacatcttgacttttttcctcttgactcagctctctacctggggcaccatattggggcattctaaatatcaggccctaggtagtggctcctagaaggccatgttcactgtagctttttttttttaagcagttctagaagaaaagagccaaaggtgcctcttccccagcagaggcaacagtatgcattgcataccaactgagtcacctgctcatttctgaaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacatgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaacttttttattaatcagttttataattgacaaataaaaattgtgtatattgtatttattgtgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagattgatcaataaaacctactgtaaacttaccaagatcgtgtggtaccaaaacacactccacaggattacgagattgggagctctagggaagcccgataaaatccaattttaaaatagcacaaaaattaactaactattgggtactaagcttagtatctggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctgattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcccaccatgtgcgaggtgccatgctccgtgctcagaacacagctgtgaaccaggtggacatggtgcccttcctagaaacaaaatctaggctgcaagaatggtggctttaactcacttcaagaaatgcattcaccaagcaccttctctgtgccagcttttgcaggggatgaggcgatgtcacagatatatcagacacagcactgctctgaaatgctcatggaataatagaggagacaggctagaaaatgaggtccattatttgtgttttaaaattaggccaggcacactgttcacaatagcaaagacttggaaccaacccaatacccatcaatgacagactggataaagaaaatgtggcacatatacaccacagaatactatgtagccataaaaaaggattagttcatgtcctttgcagggacatggatgaagctggaaaccatcattctcagcaaactatcacaaggacagaaaactagacattgcatgttttcactcataagtgggaattgaacaataagaacacatggacacagggaggggaacatcacatactggggcctgtcagggcgtggggggctaggggagggatagcattatgagaaatatctaatgtagatgatgggttgatgggtgcagcaaaccaccatggcacgtgtacacctatgttacaaacctgcacattctgcacatgtacaccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaactcaggaggcggaggttgtgatgagttgagatgacaccattgcactccagcctgggcaacaaaagcaaaactctgcctcaaaaaaaaaaaattaaattaaaaaaactaataaaataaaataaataaataaataataaaataaaatcaggccagctgcagtggaacactcacgtctttaatccctttgcactgtaacccctaagtactttggtaagccaaggcaggaggaccacatgaggtcagaagttcaagaccagcctcggcaacatagaagtttaatttaaaaaaaaaattaaatttaaaaatagccaggtacagtggtgcacacctgtagccccagctactcagggctgaggcaggaggatcacttgagcccaggagtttgaggctgcagtgacctatgattggaacccgggagtttgaggctgcagtgactgattatcatgccactgcactccaacctgggtgacacagcgagatcctgtctctaagtaataatgatgatgataaattaaaaaataataatttttattatgttgttgttactaacaaaatttattgagcccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgaccgggctgtgactcaagccaagagctgtttgtctccaagactcttaaagactcttttttaaaaccagcatgctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcggtcatttaatgacaaagggtaactggacaacctaccaccagcaatttatttttagaccaagttaagtcatacttctatgcatgacctcattcccatgactctcctgccctgcccccagttactgtcctcagctctatgatgcaaatattctgcagacgtgtctctgccctgcaagattccctagacagctttaccttgactacagatatgtcaatgtccgccaccatagaaaggtctttctgcagaccgaactgaactgatgctagcttgttccatcaggaccccttctttcactgtgcaaactgtcccccaagctcctgtgctccaatcagacaatcagaactttccattcatttcagcaaagttctattgagcttccactctgggttgggtagtagtctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggccatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacgcctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgggcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttaagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttctttcatagtaacaaaaagaaaatgttgaccacctgtattagtccattttcacactgctataaagagctgcctgagactgggtgatttattaaaaaaaagagatttaattggcccacagttctgcatggctggggagttctcagggaatttacaatcatggccgaaggggaaacaggcatgtcttacatggcagcaggcaagagaggagagcaggggaaacagccacttataaaaccatcggctttcttgaaaactcactcactatcacaagaacagcatggaggaaagagcccccatgatccagtcacctcccaccaggtccttcccttgacatgcggagattacagttagagatgagatttgggtggggacacagagtcaaaccttatcaccaccctatttacaattgggactccaaccctctcaacatgccctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattaaataaatagtctgaatgactgaatggccaaacctggaggtatctcttcccaacccctcttcctcttatttttttaagcaaaaaacaataggctattttttcatgccaagaaaactgagcctccatgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcttaagcacatgggacacaaaccttgcattaaatcaaagacttaatccaagttaagccaccctggatgaggagctagagctggagacatgtaattaacaccagccagtcagcaccaactgcttcagctgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacctgtgctttttcattcaatgttccctcaccaatcatctagaacagtatgtagcatatatcaggcactcagtacctaactgctgagttaatttgttggctagttatctgattgattgactgattgattgggtggttaattaaatggttaattaatttacctcctgaggctgggcccccatatggccacctagctaagaaacaccatcaaaccgggggtgggtattttggttacgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcatctaccctccagtgaactagaacttttgtcagctcctcaaagtcaccaggttcttgccacatatgacgtctcttcctagaacagtcctctccatcatgccatagtcttcaactctggccagcgcctgctccccaggtgtcccctgtctgcactcaccacactcttcttgcagtgaatcaccagactgtgggttccacgaagcgagagcccttgccttcttcttccccatggtatcccagtgtctagggcattgccagactcatgcttgaatatttgctaatttggataggagttatcatcttatttcacagatggaagttatgaactttttacacacctaatgtacgggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcactcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacgtaatggctatgtgaccttaaacaagttatctcagctctctaaatctttttctcatttataaaatgacaatcatggtaaatttataattcattcaacaccgttctcaaggctaggaatatggcagtaaacaacagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcgcttgaacccgggaggcagaggttgcagtgagctgagatcgcgccattgcacttcagcctgggcaacaagagcaaaactctgtctcaaaaaaaaaagaagaagaaggccagtggtgcctctggcatccccaaaagcaagcctccaataccacaaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcccctagcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccaatgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggacggtgctactggtatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctgatggagggtatgctggtgtgacctgttactatttagtcaaaggaagattcacagacccaaggaccagcagttctataagaaagtcttacaaagctccttaggaagacacatacagaaataatcattgcaaggttatttgtggaaggtggaggtaacgaggttgtctatcattggggaactaggcagataaaagtggatgagcaaataccgtggggtattagaagtgaccttttttttttaatttttctttttcttcttttttttttttttgagacggcgtttcactccagcccaggctggagtgcagtggcatgatttcagctcactgcaacctccatctcctgggttcaagtgattctcctgcttcagcctgctgaatagctggaattacaggtgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatggaccttacagctttaatgagagtgaggagggggagttaaaaaaaaaaaaacaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcctcctttcatgaagttcaaaaccaggcaaaactaatcaacagtgttagaggtcattacactaatgtcctttggaaaggatagactttttttttttttttttttttttgagacggagtctcgctctgtcgcccaggctggagtgcaatggcgtgatctcggctcactgcaagctccgcctcccaggttcacaccattctcctgcctcagcctcccgagtagctgggactacaggtgcccgccaccacgcccggctggaaaggatagactttaaggattgacagggagactcctgcagggtcagaaatattctatatgttcatctaggtggtgattacacaagatctatacgtatgtaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggccgttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcgggaagctgaggcaggagaattgcttgaacttcggaggtggaggttgcagtgagccaagatggtgccactgagccgaatccatcaaaagaaaagaaaaggagaaacaaaagaaaagaaaaggaaagagaaaaaagaaaaagaaaagaaaaggaagggaagggaagggaaagaaaaggaaaaggaaaaggaaagagagggagggaggaaggaaggaaggaaggaaggaaggaaaacctatacacagatacacaaatttatagacactctattcatagttagcaaaacctggagaaaatctaaatagcctccaaagaggaagtggataaacaaacatccacaccatggaatactatttggcaattaaacaacaaacaaactcctgatacataataaccagaatgaatctcacaggcattatcctgagtgaaataagtcagcctcaaaaggttattatcttagtccattcaggttgctatataccaaaataccataaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcatgggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcaactttactatatgtacttaaagtataaaataaatgagatattgattcagagtcatattccacaattaataactatattaggaataaacaaatacgcgcacacaatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcggcaacacctcttcagtgtttctgcctagagaagcccacgtttaggctcaaagtttgggtgttttattgagagctggtcacataagcacaaaaactagaaacaactattgaaattccaggctcctggaaaggaagcaggtattctgggcgcgaagcaggtattctgggagctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagacggaagattctcaccctactgcaatgactctcccagcccactgccaccaaagtttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccatagaaactctctgatattaattgatctgctcctagttttcagttattctattttttaaaacatgcgacagtgttaactaggcaggctcactagcatgatggatggatgagtgagtgggtgggtaggttgatggatgaatggatggacagatgaacaaatggacagatggatggatggatggatggatggatggatggatggatggatggatggatggatggacagatggacggacagatgaatggatggatggatgggtgggtggatggatggatggatggaaaaatggatggatgtatagatggagatagatatagacagaactagatacagacaaatagagacatcgttaaagagagagaggtaattatttatttttgcaacaagtatttattatctactttaggtcaggcactgctccagcttataactgtttgttataacagtaaccaaaacaaacaaacatccactaccttcccggagcttagagagagactataaaaattaaaaataatatatagaattatagatggtgttaagtgctatggggagagaaacatcaagtaaaggggcttgggaccggctggaaagagttccagttcttaaagaatagggtcaggaaaggactcaccagaaaagtgacttttgaatggagacctaaaacagatgagagtgttcaggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccaccccttatgttataataatgtggtaacacaaaaaggtgggatggcatgtcacatattgactcggaagtaggcaaaaacgtgagaccaacttgggcttagatacacatacctaggaatatactaggtgaagtcaaagacagcaggagattgatattctacataaatatggaaatgcactttatgagttcttgagaatctctggggatttttcataggtctcacccatcactggtcatgtaaatatgtcatttttagcaaaatcacattctcttcacttctatctgttctgtattgctgcaaggactgctttttgaactagggtatgacaatgatccgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagcctacaccacaacaggccagaaacgtctaccttatccctcttgaaatgctaccctgagactgacatatggggagtctgggctagactccttgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagtagacaggtgaagcaattagtagtggaaactatccattcattaaacaagtacttatggagctcctactctatgcacacacagcctagtggctcacaataagcaacctttacagccactgcttgatgaaatatctccagacaaaagtattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagattattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggtttcatttgtgcattctcagacttgtgggaagatacttcaccagccccagccttagaaatgagagtaacagagctgtacaatctctgaggtgttatgtattcttaaggatacacttactggcagggaggaaatgctctaagccatttacatacattaccgacatcttctcttttaaccctccagggatcaggcatctccacggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtacatccaactgacagatgagtttagaagctatctagtccagacaagcttgaactcagctagtccagcctttcatgcacctcacctatttagtgacagggaagtcattacttctccaagcaacttacattacgttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacaatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggggtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctccaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaccctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccattgtcaatctttacattagggtagatttttgaaacttcaggtccctacaatctagattctgatttaattagtctagggtgggaccctggcctttagtatttttttaaagctgcagccctcagtggtgactccaacgtgtagccagaattggaaaccactctaatttgtattttattttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtgtatgagaaaaagagacagagacaagcagagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagccatacagacacacgagtgtgggcaatcattgttttatagaaatgggatcatattctaccaaccgttcccatgtattcaacaattccttgttgtaagccctccaagttgatttctcaaagaactaaaaatggaactttcactggacccagcaatcccatcgttgatatgtacccaaaggaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaagaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctctagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaaccttgtcttaaccacctttgtattccctgcagcgccttatacaaggcaggtgcttgatacaggttgaatgaagattatgtttaccaggttccaggtaagtggaaggaaattaaaagacagcccagctggaaacagtgggcaggcattacaggcaggcccagctttctaacagctatcataaaactggctgctcgctggagctgtgaatttcccatcgctggttagagaaattctttaaaagggagattcttttaaaaatggctgtcctagatgatgtctaagctcatctaattttcactaggttactacaatggagaatggttgatgagtaagcaaagacagcagaaacccactacacagtgaaataggaatagatgtgtgttattgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttttagagataggggtctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttaccttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattaccaatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcatcttctctgttaatgcccttatacaatcccctcaccatgagtgtgccatgtttctaaatccaaaagtgatgagtgtcacttccatgattgggatagaagagattgacttccatcttgccaccagactctctagattgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcacatccatattcctggcccacaactataagataataaatgtgggtcagtcaagctgcttaagtcatggggtcacctggtatgtagcaacagatcccaacataagacaatgtgtaatatttctataattagaaaatattccatcctagatatctcctcctgaaagccattcctgagctcccagaccagggtgtttttgtcacctctgtcatggtcttcatcatcctgaatttaataattaatatgccctgcctccccatctttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctgcagatgccaaatcaagggtaagggaggccttcaatattcagcaaaatctctactccatgcatcccccacatcattttctaagcagtttcttcctttccatcaccagggtgcttatcaattgtacattgacaattcctcccatctgttcaattcatctgttggatggtcactctctgccacttcagagcaatggggagttcactctgcctttcatacccctctgggaagcccaggaaaattatctctgattaatgtcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaatagcttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgcagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaggaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattcaaggccacctccaaaaggtaatcccgaactaagctgtccacctcccatgctaagtcattctttatcttgttcctttattgtattttttccataacacatcaccattttaaattaacttagttattgcctgcctccccatgaatatataagcttcatgaaagcaaagtgtgttcctgacttactcactattgtgaaaccaacatgctagcacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcatgcattctccatcattcctagacactgtgtgggaagacaggagattatagcttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagccactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatcggattagtgactttataagagatcccagagagatctttgtccctcctatcaggtcagattatagtgaaaagtcatccatgtaagaaccaggaagcaggtcctcagcagacactgaatctgtagataccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagagtcataatgttctttatctacatgacactttccatctttaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacatctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgactttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccattctgatttcaaattctccatcacttccctgctgtgaaggctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactagttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttaccaaacatcagttatctctatttaaggcattcccctacctccacagaaagaatgaatcattttaagcagtagtttaagcttttactctatccaaacaaaattggcgaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactggtcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaaacgataattactttggctatggaactccaggctattatctggggtgacattttccctcaggttggaatccagatatgtgagacaattaacatttcataaaaataacttttgaagcaatgtttgtccacctttctgtatctcagttgtctcctctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcacttatcttccaggctgccccctttgagcatcgcttgtaaagactcccactccaaagtggacccttgctgtggtttccatagctctcaggacttccctttgcattgtgtaactcactttggatcactcgtaagatggctgccaccctaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggtaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggatacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttggggacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaacgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttctttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgatggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaacggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggacggaggcttggtgagattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgtaggacatttcccatgtcctacaagcctcctcctgcctttggtagaggtgagtgtaaataaacaaaatgtttcctgcactcaaatgccctcctctattttatttgttatgggagcaaacttccatctccaggacagcagagtgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaagatggtcttttttttgtttttttttttttttgagacggagtctcgctctgtccctcaggctggagtgcagtggcgcaaactcggctcactgcaagctccgcctcctgggttcacgccattctcctgcctcagcctcccgagtagctgggactacaggcgcacaccaccacgcccggctaatttttgttgtattttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggagggcaccaagccattcatgagggatctgcctccatgaccccaacccctcccatgagtctgccacctccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaaatggcttgcacaagatctgtctgactccaagttctacaggctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcctctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaggaaggaatatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtccttgacatatctgtaacaataaatctttgttccactcatcaccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggaggggagactaaaaaaatgtaaatggatttaccaaaataatctcgaggtaagacctttgaggcttgataccacagaagtgccatattgtttttaagtttctttttttttcttttgtaagtttatttttctcctcggagggcactgaaagttttgttgtgagaagcaataaagttctgttttccaaaagaaaataaaagcatgattgtatttttaaaaatcaatcttaataatttccagccattactttatgagcttaatgcaactcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagcctaagtgtccttatcctgactccatgctctttccagtgagttcttcgccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatgtgtccttttctggctgggagcagtgcctcatgcccgtaatcctagcactttgggaggctaaggcaggaggatcacttgagcccaggagttcgagactggcctgggcagcacagcgaggtctcgactctattattttttaaaaaatagaatatgtcctttcccccttgcctgcctggataaaaccttcttttttatctcttgctgcttcccacttcgcattttctgctctgttaaacatcaaaccgcttctgttgcccagaactatgtctcaggttccacgcaactgtgcctctgcaatgctgtgcctttttcccaaatgctgttcctctacaatccacttagcaaactcctgttcatccatcaaaaccctgataaaacataaccttttaaaagaagtcatcttcatccctctcccacttctagacccaatggaattcacacgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctattgcagagcaatcaaccagaccatgtttccctaataccgattacaaagctggcacagaggcaagacggagcagcagtggggatttatgctctctggacatctgttgggcgtctcttctgataaatcctcgccttgccctgctgatgatctcatctttcagaagacagaggaagcgacagaggaaacggttacttgccactaaatcctggcaacgaggaaacactggttaatgagaaaagtggaatcgttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagaaagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacatatacatacacacacactgaaatccaaatcacggtcatgtgacacgatcaagctatttcttccagccttggcagctttctaggacaggcagccaccctcctttgtgtgctggctcagttctccactttgcttccacctcatgaggctccatctcaacagatgcttcagagcttgcctcattcagggggaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttttgaaagatgagaaagcaagcttccatatgcagcaatgaacactggccaagcccggcctctgtgtactaccaggggagagaggagaaacatgaaaacaaaaattaatatgtagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcctctttctcttcttatagggacactaatcccattgataagggctccacccttgtgatttaattacctcccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgtgatctcctgacctcgtgatccgcccgccttggcctcccaaagtgctggaattacaggcgtgagccaccacgcccggccgaccctttttgttcttatttgatcattccaggaatgctcataccttagtgcctaggtactgtggggttctctcttcctagaacacttctcagaaaatgagagaatgtcttgttcaagtgctattatatttactcattgaaaccttccataattacctacttgaaattatagcatccactccactcctcacactctctatcctctttccttcctgtattttcacattggtaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttttgagacggactcttcctctgtcgcccaggctggagtgcagtggtacaatctcggctcattgcaagctccgcctcccaggttcagccattctcctgcctcagcctcctgagtagctgggattacaggtgcccaccaccactcctggctaattttttgtatttttagtagagatggggtttcactgtgttagccaggatggtctcgatctcctgacatcatgatctgcctgcctcggtctctcaaagtgctgggattacaggtttgagccaccgtgcccggcctagggcatgtcttatttctatatactccttctacaccttttactctggcattgcaaattcctagcaaaacatcctgaagggttcatgctgaaagggcaacctactcttcccatactatcttactgaaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgtttgttttcagggaaatgaggttgagatcaaaaccaggacccagctcatgtgattctgtatcataaagaatatggaagtacatgtatggagctctagtgaaatttgcttggactcagttaagatgcaatggtttgcaagtagttataacacctcaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaattggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacaggaccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcattgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacagaggagaaaactatcatctgcaatccaggaagagcccctccccaagaaccgaatcagcaggcaccatgatctcagacttcccagtctctagatctgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagagatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctctctctctctcacaaacaaacacacacacacacacacacacacacacacaatgggtttgggattcagaaaggcacagttcctaaactggctctgtcatttatcatctatgtgacctgaaggcaattcacttaatctccatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccacgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagcttttggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttgaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgcttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaatgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcagatcctattccattccctttatctccctgtttccattaaaaataaaagcctcggagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacaacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggcgggtgaatcacctgaggtcaggagtttgagaccagcctgaccaacatgatgaaaccctgtctctactaaattaaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcacgcagcccactttcctgactcatgcccatgcaaaccccagctaggcaacaaatacttaaattttttgtttttattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaacccctcaaaaccaacaaaataaaacaaagcacctcttcctttccttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcccgttgccccaaggtctcagaagaggggatgtgctacaatggggagttatgggttttgcaatcagaccctgacacttcactagctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggcgggttcagaaacagcagagaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcttcctgaggtcggctcgatcccaacttcatgtctgtcccatccgccctcttcaattccactctcctctctccagttatgacccctggatgcctgaagaagccttctaactgtgctctccactgttcagctctgctccctccaatctgccctgcatgagcccctgagggatctcaccctttcagcaggtccacctacaagtataacccctctaggtgacataccttccttcgggaagcttctcccagcaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagacgaacaacgacaagtattgacgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgatgtgctgatccacactgcaacacagatgggtctttaaaagctatgtaagtgaaagaagccagtcacaaagaaacatatgttatttcattccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattcctatcacttcctcattgttcaatatggcttcatatatttcttcataaataaatatactgatttaatacgtgtttattcgcttattgtctaccacaacagtaaaggtaatttcaatgagagcagagcctgtggcgcgttcacttctatattcccagtgctttgagcatggcacaaaaggctactgaataagtaagtgccagtgtgtgaatatatgagtacctgtaagaatcagcaaaaataaaatactgtttccagggccccacccccagagattcagacgcaattgatctgagggagagcctgacaaaggtctggctcaagactcctcgagtgataccattgtacaaaccaagacgaagagccctgatccacagcagctgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccagaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacacgctgaaggtagggatctacagagtcacattcatgcaaggtctgtggcacaaggcctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacaccgtatttggtaaatactagtggaatgaattatccgtaccttacatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccggctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatccgatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcatgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagaggaagccagagatacagatgagaggctatccaaggagccactaaatgaggggcttggggccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcacctcttcaggtccctgccatggggaagagagataacgtttgtttgtttgtttgtttgtttgttttttagatgcagtttcgttctttttgcccaggctggagtgcaatggcccgatctgggctcactgcaacctctgcctcctaggttcaagtgattctcctgcctcagcctcccaagtagctgggattacaggtgcccgccaccacgcccagctgattttgtatttttagtagagacggggtttcactatgttggccaggctggtcttgaactcctgacctcagatgatccgcctgcctcagcctcccaaaatgctggaattacaagcatgagccaccgcatctggccagaagtgaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttatattccctgtaagggcagaaattcagctcatgtaaacctcacagcaatccttatgcccatctaacagagatggaaatggagactcaaagaggtaaagaaactcacccaaagaaccccagctaaaacatttagcagagtagggatttgaacccaggcctgtccacctgcacatcccttgcttgtttgccttattgagctgtctcctcaatttcatcttcaccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaagcctcaactgtagaatctcttgattatcaccaagtatatgggcttccaagcctacctaccttcaaagtcaaggtcatcacaaagggataatccctcaggcaaaaagaaagatgagttttaggggtcccctggtttccatagaaaaggcactccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaactcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctatatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaaagtttcctttggtggagagagaagaagaagggtaataggaatgaaaatgggacctctctaaggctgagaagaggggagaaccaagaaagaggagtgtgggagtgctttgttctgccaggtgcagtcaataggtgccttgtctgtagagaatttaaaaaacagtaatacaatcaactattaaatgcaattggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtggtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttgggacattgttaatgttctgtaaagacaaatataaaacaaaatttgaaaacaaaaacagaaagagccacaatattgggcatgaataatccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggcatgaaccaccaggcctggcctcaagttcaggtttgagcagctctcaccaaaatcccactgcagtaaaattcgcagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctccccatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctattgaaacggggtcacacctcccatctctctccattctctatacctactttatctccttaatgctcactacctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagacgatcttggctaacacggtgaaaccccatctctactaaaaaaatacaaaaaaattagccgggcacgggggcgggcgcctgtagtcccagctactcgggaggctgaggcaggagcatggtgtgaactctggaggcggagcatgcagtgagccgagatggcgccactgcacaccaggctgggtgacagagcgagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagatggagaccaccctggctaacacggtgaaaccccgtctctagtaaaaatacaaaaaaaaaaaaaaaaaaaaaaaatcagcggggcgtggtggcgggcgcctgtagtcccaggtactcgggaggctgaggcaggagaatggcgtgaccccgggaggcggagcttgcagtgagccgagatggtgccactgcactccagcctgggcgacagagcgagactccatctcaaaaaaatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcttgctatgctgcctggggtaactgcacaaggccccataattagacgaccccactgtgatgctggcattttgaaattcctataatttttttttttttttttttttttgagacaaggtctttctctgtcacccaggctacaatgcagtggcatgaggctcactgcagcctcaacctcctaggctcaagcggtcctcctgccttagcctcccgagtaactaggaccacagatgtataccaccattcccggctgatttatttatttattttttttaattaattaatttatttttttttgtagagatgcagttttgccatgttgcccaggctggtctcaaactcctggactcaaagcaactccccagcctcagcctccgaaagtattgggattacaggtgtgagcccctgcacccagccagaattcctataattttcataacaagaatcaccacattttcgttttgtgctgggccctgaaaactatgcagccagttctgcccaagatgcttattttatttcattttcccagctttacaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagaggctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcacttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaaaaagacctactacttgatagcacaacagagtgactatagtcaataatttaattgcacttttttttttttttttgagacagagccttgctctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccaggatggtctcaaactctagacctcgtgatccacctgcttcggcctcccaaagtgtggggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccataaatatatacatttattatatacccacaaaaagtaaaaaaaaaaatttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaatagaggaggagagatttctctctaaaaatgtaagggattccaattaaaaatcacctctcattgtacatgcagaaaatgtacagtgagacacaaagttgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacattaccagttagattttccaagcacagttcatactgcagaattcacctaacttgatttaggtttctcctttataatcagtttccacttgaacttcaactaccacgaaaaagtaagtaagtaaagcaaagacgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgccagaagtttattccaagcctctgacagtaggagtcctgaaatccacctggtggatgaaggaggaaacaaaatttagaggacttggcagaatcacagaatgtggggagatgtttccaaaggggacctcatctcatgctgcaaacgttttgtctggagaataccaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaatgcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcactagctgagtaggtttcctgcaggcaatgggagacgcaaagttctgcacttaagctcctgtaggggaaaaagcagagccagcgtgggttggggccaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggataggaggaatgcttcagcccaagagtttgagaccagcctgggcaacacagtgagactctgtctctacacactttatttttttttgttttttttttttgtttgttttttaaattagccaggtaggatgctacaggcctgtggttccagctacatgggaggctgaagtgggaggatcacttgagcacaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctctgttagtgtactggtatggaccagtagggtccatacttgcacaaatcccaacaatcggtatttacatctctttgcttggccagggcccacaatgcctgtgcacaggacaggtcggaagtcctggagaattaacatacctcctgcattaggtcttcaccagtgactaacaggagggacgtataaatatcccagctccttcactcctccagggggtgattctgagctacatgctcaacactagggttggcaaacttcttgaaaaagggtcatatagtaaatattttatgttttgcaggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttccccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatacttttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacacggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttatttatcaaatacataagaaaactcatttaatatggttattttgattgcatgtgctcttgggttttagctccctaatagccagagcaaaagaaaaagaaaacataaaggacacatgaatatcatcatttaacaaagggaagtatagctgttcacaggaaaggaaatgatttttcttagaatagaattcaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctacccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttgggttagacgaggtcatgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttgtattagtccattctcacactgctaataaagacatgcctgagactgggtaatttgtaaagaaaaagaagtttaatggattcaagttccacatgttgtcatatgccacacttcttagggatgaatgaacatcaccatgatgccacacttcctagggatgaatcaacgtcagaattttttttttttttaagttctgggatacaagtgcagaatgtgtaggtttcttacgtaggtatacatgtgtcatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctttcttctctcccagctgggctgggcttcaggtgcctcctatatgcttcctccatatcacctccacccttgcttgtcattgtctgggtttgtattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaccttgcttggagtggcatcaccccaatctctgcctccatctggatatatcaccttcttgtcttctgggtgtaatatctctccacctttctcttataagacacttgcaatcaaatttagggcccacctagataatccagaataatctccccatgtcaacatccttaatttaatcatacctgcaaagactccttttccttataatttaacatatacaggttccgcggactagaacctgctatctttgagtggccatgattcagcctactataggtttcatcactatctctttatcaactctgaagtccttgacagcagagaccacctgtggccattttcaaatggctgtacatttttacatcaaagcaatcccttagggccaggcacggtggctcacatcagtaatctcagcaatttgggaggccaaggcaggcagatcacctgaggtcaggagttccagacccacctggccaacacagtgaaaccccgtctccactaaaaatacaaaaattagctgatgtggtggtgggcgcctgtagtcccagctgctcgggaggctgaggcacgagaatcacttgaatccaggaggcggaggttgcagtcagccgaggtcacaccactgcactccagcctgggtgacagaggcagactccgtctcaaaaaaaatacaaaaaacaaacaaacaaaaacacacaacaatctcttgggatctacaccctctcccttgactttaatgacctccatgattgctttgacgtattgaatatggtggaaatcatactgtgcccttttccagtccatgttttaaaagactatcaagcgctacttcctatatcttggaatactcacttttggaactcagacaccactatgctacgagaagcccaaaccacatagaaaggccacatgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacaaaactctagaagctatggattctagggagttgagctggagatcaggaggaatggatattaggtctcaaagaaatgacaaggtaataaggtagaagaagaaggctgtggataaacaaattttctggagccttaatggtggtgagaagtgggcaagttcaatgttgagcaggaccaaattcaacagaccctcagcaaatgtttgctgacttagcagtacacagattctgcacacatcttccttccttttaaccattcctttaattgtataagcaatatattgagtatctactgagagccaggctttgagttgggtgaagactattcagcagttaagtccctttaacgcttatacactgttgatgggaatgtatattagtccagtcactggaaagcagtttggagatttctcaagtaacttaaaatagaactaaggttgaatccagcaatcccattcatgggtataaatcccaaaagaataatcattctaccttaaagatgcatgcacacatatgttcattgcagcactatttacaatagcaaagacacgaatcaacctagatgcccatcaattgcagactagataaagaaagtatggtacatatacaccatggaatatactatgcagccataaaaaagaatgaaatcatgacctttgcagcaacatggatggagctggatgccattatcttaagcaaattaacacaggaaaagaaaaccaaatattgcacattctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttatccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaaagccagaccattcaatgctattgcttctctcttccaaatgggatgaagtgcaggcagtaaacaaaggaagatgaacttggccaagtccttctattcattttgtggcagtgatgacaatttcccattgtggggagctggaggggcagtctccttctgttcaaatgactcagtacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctcttttcccaactcatggttcttaagaataactgaagaatgtgctagaaatgcaacatcttgagatagagagggactggccagaacgacccaacctctgtttcagtccacccctagaaacaaaatgtcttaaacactttagcccagcaaatcacacatcctggggtataaaacacagaaccagctgctttctggggtatctgagcttctgtgcaagtaaggcatgcacagatatgactctacttaccctcagcaggtttccggggacttggaggaatagctcacaatgaatcctaggcttctaccatctcttgctgcctatctgtaagtaataaacctacctcaggtaacttgttgtgtgggagtgttctgtctcactggacaagttggtagccagtgaacagtgaacctgcttcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggattttcccagccagtgactgggcacagtggaagtaacggaattaggtgattctaacccaactgggagttgtccaacagagagagttgccttaggaactattacactggctgatacattctcagagttgtgccgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgtgcctgtgatcccagcactttgggactctgaagtgagcagaccacttgaggtcaggagttcgaaaccagcctggcaaacatggtgaaaccccatctctactaaaaaaatattagtcgggcgtggtggagcatgcctgtaatcccagctactcggcaggctgaggcagaagaatcgcttgaacctgagaggcagaggttgcattgagcagagatcatgctactacaaatcagtctgggtgacagagcaagattctgtctaaataaaatataatgataatagtaataataatgcagtttcaaatagctagaaggaagatactgaatgttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaaagaaatatagaatgttatacttgtaaaaagaagaaaatggaaactgaggaatcaaattatgtaagagtgatcttccttctcatcagctatcattttagaaatttgtaggaaaagaaaaggagataaaggaagacagcaagaggaagcaaataagcagagggaggaaaagagcagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcgcaggttacggtgagccgagatcgcgccactacactcaagcctggcaacagagtgagactccgcctcaaaaaaaaaaaaaaaaattagtaagagaatgagaacttcatacagaagttgaaaagtggatttgaaatcagtggagactgggaccttgtacaattaattctgttttgccttctgctactcagaggacctgaactgactcacctaccatctagagacagctactattttgtatttcttttttagtttcatgcatttaatttgcatgattatcattttgctttatttctccattttacattataatatgtgccacctcatgttactgtgcttcatgtctattatcgatgccccataacattctattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagtcgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttctttcttttctgtttttttttttttttttttgacacagagtcttactccatcacccaggctggagtgcagtggcatgatctcagttcactgcaaccttcacttcatgggttcaagcaattctcatgcctcagcctcccaaaagatttccatggaaggtgcttgcaaagggaaaaataacttgtgtggtcaaaaagtttagaaacccctggtctaaacggcgctagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagcactttgggaggccaagatgggcagatcacttggatcaggagttcaagacagcctggccaacgtggtggaacctcatctctctaaaaatacaaaaaaaaaaaaaattatccaggtgtggtagataattatccagtagtctcagctactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaacgctcagagtgccactgttcaagctcctcttgctccataatcactttaaagaggctgcccccacccccggggctcagagggcttcctgtgtcctgacactatgatcgtgagcgagcgccgcgctctgttcccaactatgcttcctcatctgtcatccacggcttttcttttaaggagttatttacgaagaggtgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgagaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatgtatcatgttgaatttctcatctcttgtgaatgccatgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatccccgaattctattcatgatagaatgtttgagcatctgtggaccccagtttgtgaactcttgccctgaaacaaagcctgccagttatctgtgttcagtcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataattaaactgcagaggaaagagacttaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccactgctgctttgcttagctaactcctacccatcctcaggtctcagctcagcaaagtcacttcctcagggcagtcaagctttgccactcatcaagactaggtaaaattttcttgttaaatctatttatggattttcctggttctttgtatttttcatcatcttagataggttaggtttccccagaaacaaatcctaagagaaggtgagacggtttggctgcgtccctacccagatctcaccttgaattgtaacaatctccatgtgtcaagggcgggggcaggtggagataattgaatcataggggtggtttcccccatactgttctcctgatagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagttcctatgccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacatgtgaaaaaatgctcaacatcactaatgatcagggaaacgcaaatcaaaaccacaatgcgataccgccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactctggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaagaggggtgtctaaggccctctctgacattctaacaacccccatcatctcttttgctggccaggggcccacctggtaggacagtccaatccagggtaattctggctcacaggtcacgcaataccaatctttggtcccaaggttaggagtggctgctctcacaatggactttataataacctctccaacctctgtttgttgagcttagattcttaagcctctaagcttctgatgactcttactagagaaagtaatataattacccatcaatagagaaatggctcattcagcaaggatatatctgttcaatcaaatatatttgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccatggcccacgcctgtaatcccagcactttgggaggccaaggtgggtggatcatgaggtcaggagatcgagaccatcctgccaacatggtgaaacctgtctctactgaaaatacaaaaattagctgggcgtggcggtgcgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggcttatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcacgatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatgcacttctttggttttgctcttcctctttctctctttcccttatccctgctttcttgagattgcgtgacccaatgaaacattcacatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaattcaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaataaagacatacctgagactgggtcatttttacaggaaagaggtttaatggactcagagttccacatggctggggagcctcgcaatcatggtggaaggcaaggaggagcaagtcacgtcttacatggatggcagcaggcaaaaagagagcttgtgcagggaaactccctgttataaaaccatcagatctcatgagacttactatcatgagaatagcatgagaaagacccacccccatgattcaattacctcccaccgggtccctctcacaacatgtgagaattcaagatgagatttggatggggacacagccaaatcatatcagtgggacaggatggaagctgggctcagagcaacttctctccctttccatgtcatctcagagtctctccaggtttccctccagcaaaagccctcagatttctcacacagtggctcaggggtttaaaaccaagagttccaagaggtgtaaggcagaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaaactgggaggaggggtgggtggaagactgaagcattagagtaagaggggctccttcatcctccggtcatcatttgccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaacagccacataagcatcttatttggagttacagagataaataaccgaagacctaaaaatggaaacaacatttcaagcacttgcctccgggaaataagacttaaggaggggagagaggagagaaggggccaggaaccgctgctttcattagcagctcctctgtactttaactttgtacgatgtgctcatattactatgatttttttttttaaattcaaaagggaaaaaaataagaacaaaatgatgatggttatttttaaaactatgtaattaaacctggaaaaatctcattttgctaaacggaaaaaaagtagcaggatactaaactatattaatagtatggtcataagtatgtttaataaagaaagagaaaaacatatatgggaggagaaaaatctgaagaaatttactaccaaatgatagtgggtgggtttctctacttttctaggtttcccacattttcagcaacgtgattctcatactttcctaatgaaaagaaatacattcattacataaaataaattaactgggccaggcgtggtggctcatgcctgtaatcccagcacttcgagaggccaaggtgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaaaataaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctgaggcagagaattgcttgaacctgggaggcagaggttgcagtgagccgagattgcgccactgcactccagcctgagtgacagagcaagactccgtctcaaaaaaaaaataaaaaaattaaaaaataaaaataaaataataaaataaatgagccgagcatcaattaaataaaatgccagaagggtctctgaagaactttccacaatagaagtgtattttaagtccctgagccttcatctcatgcctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacaggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggcagatcacttgatcctgagagttcgaggccagcctgggtaatatgacgaaacctcatctctacaaaaagtacacaagttagctgggcatggtagcatgcaattgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaagcggaaaagctgttgccagcacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttatctcagaagagttataagaattaaactagagaagaagtgagcattgtttatatgtgcttgttgctatggatccaaaactgccagtaataacaataataataataataataatagcttatgctttcgttgagcccttgctttgcacctggccagtgacaggcacattatcagtaacacaaatgcaagtatctcatctaacccttgcatcaacgctcagagatgggttttatcagcatccccattttacagatgaggaaaactgaggcagagcagttgcacaacgtcgcagctgttcctggtgcttcacccagatcctcattgccagtaaaccactcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcaaggcagaatacactccagagacccacgtgagatcaaggctagcctcagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccccacgtgaaaccaccaagctgcaccaggctcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtttatttgttctcacgctgctaataaagacctacccgagactgagtaatttacaaaggaaagaggttgaatggactcacagttccacaaggctgaggaggtctcacaatcatggtggaaggccagagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccccgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcggccgggcgcggtggctcacgcctgtaatcccagcactttgggaggccgaggcgggcggctcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcactgttgcacaccagcctgggcaacatagcaagactccgtctcaaacaaacaaaaaaagggggaggggcggggctttagacagatccaagctcaaccctgcaagttgccgagactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttatccaaaatcaaagaacttctacaaaatagaaacagccccctgccccctcctgcccccgcccgcctgctaccttaataggttgtttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcgtttgtaggcagaatgggttttcttgagaccattacaaacagactgcctaaattgcaaagattccaggcttgacagctcccggaggactccagatggaaagaacaccacccccatctcttatacatccaggctgctgtctgtggatgtccgaaggttttcccaccacccatgctattgttgaaattccacaatcaacctgcaatgccccagtgaaccattttgctgggatgggaggaccaacttagggccaaccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagacgacaggctaggataattgatcattagaacatctgtgctgtttttgttgtaagaatagtatcaatattaataacaacagcaaatatatattgagtggcttctggagccaggcactgtggtaaacttttgcacgtatcctctcacttaatcctcacagtgctctacaaagtgggtactggtttcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgccagctactcaggaggctgagacaggagaattgcttgaaccccgggagacagaaattgcagtaagccaagatcgtgccactgcactccagcctgggcaacaagagcgaaactccgtctcaaaaaaaaaaaacaaaaaccaaccaaccaacaaacaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggtgaaatcaagctaattaacaagtggtggggatgcttcaaatttactctcttagcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcacctgaggtcaggagttcaagaccagcctggccaacatggtgaaacctcatctctagtaaaaaaaaaaatacaaaaaaaaaaaaaaaaaaaaaaaaaagctgggtatggtggcaggtgcctgtaatcccagctactcgggaggctgaggcaggagaattgcttgaacccaggaggtagaggttgcagtgagccgtgaacgtgccattgcactccagcctgggtgacaagtgcgaaactccatctcaaaaaaaaagataaaatacaaatacatccatatataattaaaatatgatagtggtatgttttcctgtttaacaaatatttacttccctctcattcccttcaccatgggaagaacagaatcctctgccctgttagtgatgggtttgttttggccaatggaacatgagcagagctgacggtgcaccagttcccagcttaggccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaataagtgtttatttttataaccatgagggtggtgttacttgttacacagctacaggtaactgatacatttacacgtgaatatgtgcacatactatacatgtgcatattatataggatacatatgtgtggccgtgttacatggaaatagatacgtataaatccttaaaatgtatctccatatgtgggatatttatacatatctatttgggagatagtaaatggggtagaatttggagactgctaaatttgcattcttgcgttgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggagaaaaaagcaaaaataaaaaggataaggagagccagcagccccggaggaggagggagggaggcataggatgtgcctgtgcctggcacgtagtaagtgctcaattattggtagccatttttattctcaaagtgattaacgtgagaacaagggggtcaactggagatttaaaaaataataatcagtctctctgctccgcagcagacccctgagacccttggcaaaccccagcaatagatcaaggaccttcagtaggtgaatacagtcgcaggaactgctagagctgacacatagtccctgcaactccagccagacgccagcaccagctgccactgggagatgtgagcttggcttctccatgaaagagaaagattcctggggcctcagccgtgcctcaaacccactgataacatcaaacacacattgctggggggagccggccaggtgctcagaagctgcagggtgaccctgcgtgtaggtgtcgggaagtcagcagcgactcgggggtggagaaacacccacacctttgcaaacactcttaatgtaatgcactgcccttgaggccacctcccgtttttttggccctaattggcatgtttttctatctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaaccttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcgattgtgattagcacagagtgaagcagcgtcattctctcgggggtaatacccgagattcgttgcctcataccaaaaacattaaggacacagacacacacaaagagtgagtttaaaagcagaggtttaataggcaaaagaatgagaaaggagaacgctgtctctcttccgagaggggggcacccagtgggacttctggcccaagtcagagtgcaccagattttacacggttggggaggcggtgcctgatttactagggcccaaagattggttgcaccaggtgtgacatttacatagcgcatggggaagttggccgccccaccctagtgttattatgcaaatggggtctttgcctggctggctccttgttgcctgctccttactgtacacatggctggcaaagagaagggaagatggagctgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggtttctagggtgactatccatcctggcttgagcactgcaagtcccacactctgggaatccgctcgggcctgggcaaaccaagacagctggtcaccctcgccgtaacataagtgagtgaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgtcctttactggggagtctggggacagccctgtgccttgtaggatgtttagcagcatccatggcctctacgtactggatgacagtagcacagtatgccctagttgtgacaatcaaaaatgtctccagacattgccaaatgtcccttatggggatagaagtgtccccagttgagaaccagtgttgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaaatggaacaagctctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcgtgggggcagatccctcaggaatggctgggtgccattctctcaagagtgagtgatttcccactcttagtttctgcaagaactgattgtgtgtgcgtgtgtgtgtgtgtttcaagatgtaatctcgctctgttgcccagactggagtgcagtggcacgatttcagctcactgcaacctctgcctcccggattcaagagattctcctgcctcagcctcccgagtagctgggattacaggcacccgccactacatccagctaatttttgtgtttttatttttttctatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtgcagagagggtttcgacatgttggccaggctggtctcgaactcctgacctcaagtgatccacccacttcggcctcccaaagtgctgggattacaggcatccagtcgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatattgatgccatgattcttgcagaatgatgagccaaataaactttttttctttgtaaattatccagcctcaggtgttcctttatagcagcacaaacaaagacacttgctataaattgattctattgctcactttttttccccttgtgctttgtttttaagatccatccaggccgggcacagtggctcacgcatgtaatcccagcactttgggaggctgcggtgggcggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaaataaaagatccatccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatgcttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtatcagatctctctagaatgaccgcgccagtccacagtcccagggcttgcttttaaagggggccaaaccccactggcccccctaacacggtgtagacttgcagggctctgctgagagccaccattaaccacaagcatcatgtctgtattgctaccgttcgtcaatacccttgaccatcttgccttaaggaaccctcaatttccaagcacatctccaaatcagagccccaccccctccacaatgcaaagtgggacaatctaggagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccacccccctcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgggttgttttcccccaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggattagacacggcgaccctaaagtcctttcagctctgagactccatgtgacgtgatgtaatgtaacagacacagcccttcctggttccaatccaagctctactactaaacgagtgatgagatggctcaccaactgtacctaccactgactagctgtgtgacccttaactaactgtacctaccactgactagccgtgtgacccttaactaactatacctaccactgactagccgtgtgacccttaactaactacacctaccactgactagccgtgtgacccttaactaactgtacctaccactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtggcccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactgactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaatagcagctgcctctggggctgtagtagggtgaccagccatcctctttggtttatctaggaccgaagtggttccaggtatagggaacgctcagtgtcaaatccagtaaagtgctaaagcaaacacaagtttgtcacccaaggttgtagtgagaactaaaggtgaatgaggtgacatggataaaatctagcacatcaatataagttagtatcattgctattgctattgctattgctttttgtttgtttgtttagagatagagtttcactcctgtcacccaggctggagtacaatggagcactctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcacgctctgttcccactacttcaggccctcaccacattggccaggctggtcttgaactcctgacctcgtgatcctcccacctcagactcccaaagtgttaggattacaggtgttgagccaccgcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtacgggccctccaaaaggtttaatgtctctgtggtgtcatcccaaagagaagcacagagaagcaagaggatctgcagctggagagcccagaggcaatgaacactcaccttgactctcttctcatttctgaggctctatcagttaaggttcttagtttgcaagcaacagaaccaaatctttttttttttttttttttttttttttgagacaaagtctcactctgtcgcccaggctggagagtagtgcatgatctcggctcactgcaagctctgcctcttgggttcaagcgattcttctccctcagcctcctgagtagctgggagtacaggcacacgccaccatgcccagctaatttttgtatttttagtagagacagagtttcaccatattggccaggctggtctcaaactcctgacctcgtgatctgcccaccttggcctcccaaagtgctgggattacaggcgtgagccaccatgcccagccaacagaaccaaatctttacattaaaaagcggggagcttataggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcacggtggcttatgcctgtaattccaacagtgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgatgcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaagatgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgcccgcgaacaagatcctccagttagcgttaagcagattaaaggttgagaagcactaggctgcagggtcgtggaatgactggactctaatcactctacatccttgatgatctctccttaagatgcaaattcccagaaggcaagcatgtgatgggccatgcttttgtcacaccatgatagaagatctgggcataagaaattctgcagagtggtcccaccagacccacaggcaggagaagggccatccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaagtttagcacggatcagaatcacctggaagatttgtaaactcacagacttctggaacctaccctcagagttgccggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattagggaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtctttaggagggagagactgggaaacattaataccagagccctggctattatttgcaatgtatagcaatgtttttcctcaaggtagatctttggtgagccgtacacagtaaagctagccattcaggtggaattacatccaactagtcatctctgtcatactaaaaacagtaaacaatgcttgaagaagtcagatgcctggcatcaaatctaagatccaccatttactggctgtggtcattaggcaagatgcttaacgtctttgtaccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaagaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacgtggggcttacagctccctccctcgacgcaacacctggtgattataattcaagatgagatttgggtggagacacacagccaaaccatatcacctattttatttatcataccattagtgttattattattattggtggatgtgctggtggcgttaatattgttggcaaaactggaactagctggatctttatcaataattgcaatcatgattctgacatctgacccttccatgccactggtaggcatgtaaacaggcacaatttttctggaaggtcatttggcaatatgtatcaagagccttacaaatactcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttttgaaattacactatgttcgtacaatgaaatcttcttccaattattaaaataatgttcatgccttttaattggggtgattgtataattttatatctttataaaaatatatgtatgtaagacttcatatagatgatgaactcagttatgtaaacatatgatagaaaaagagaagggaataatccaaaagccatctgctctgggtcttggaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaaacccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatggttctcaaccaggggtgattcctcctcctcccctcaggggacatttggcaatgacaatggggcagggggttgtgctactggcatctagtgggcagagcctagggatgctgctacacaccttacagtgcacaggacaaccctcacccaaaggattatctagcccaaaatgtccacagtgctgagactgtgaaacccagaattaggatgaccttataagttattgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacaaagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgctgcttcgaaaagctgtctctggcatggcccctactgcagcggcgcgtgacagactgccttgcttggtggaaggaatcccaccccgattaaattgctggagccctgctgggaaggaggtggaggcaggaggagaaggagagtagggagccaggcaagccactcctgcctctcctttttcatcttggaagagccaatttcaagcttgcctcgggtcataaaagaaattaatttgattctctcagccttgctcagagtggacacacgtcttcggctggagcatctgctgctgctggatccagagcaaggagaccatcccctcgaaacgattccatttctgttgcaaggcagggccagaatcatctgcctggagctggagaagcagctgcctggaataccctgggctgtcatttttgctggtaagttccaaaaacggttctcacagctaaggtgactcccaagtctcaggaggtttacccagagagatacgcacgggtggggctggttcttggaaaactcccaaccagaatttagcactggcagctgcctaacccacttcatattgatcagcttgatcacactgagtcctcttaactgtcaggcacggcccctgggctgtattcctgattgcacacagctaaggtgactcccttgtacaagcctccccgcctgagagaggatggaatttgtgacctgcttctaatcaacagaatatggcaaaggtgccgaatgtcactctcttgatcatgtttccaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgggcgtgaaggcacctgcctgtggtcccagctacttggcaggctgagatgggatgatcccttgaatctaggagttaaaggctgcagtgagctacgacttaccactgcactccagcccgggtaacagaacaagaggctgtctcaaaataataataataataataataataataataataataataataatttcatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccttcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccatgtggctgtggaggcctcacaaatatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagatttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcgcttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgttctcaatctcttctttctttctctctctctctctctctcactctctctcccccatcttctcgctccccatctccctctctccctctctgtctctccgcccccccatgtattagtctgttttcacaatgctaataaagacatacccaagactgagtaatttataaagaaaaagagcggtcacggactcccagttccacatggctttggagatctcacaattatggcagaagacgaatgaggagcaaagtcacgtcttacatggtggcaggcaagagagtgtgtgcaggggaactcccctttttaaagccatcagatctcatgagacctattcactatcacgagaacagcatgggaaaaacccgccccatgattcaattacctcccaccatgtccctccgatgacatgtggaaattatgggagctacagtttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttccgaaggaggaatgggggtggacaaaaattattggctgagaaaatagctggtgaatgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctacgtctcatatctttgggagcatgggtggtttcccccaccctccattttcctcttctctctgaacaaaagttttagtttgtgaagtcaaatctcatctttttttttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacatcttgctaatttttatatttttagtaaagacagggtttcaccatgttggccaggctggtcttgaactcctggcctcaggtgatccacccaccttggcctcccaaagtgctgggattacaggaatgagccaccacaccctgcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacattgggggttagacttcagcctatgaatctgagggcaacacaaccaatgtctgttagttcacggcagacagtgaaatagtggaaaggagggtgtgattgattctgggaagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagaatatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcctccttccttattgtacttattgtctaaccttaaggtacttccttatggtaccattttcacacgctgataaagacatacccccacaccccagactgagtaatttataaggaaaaataggtttaatggattcacagttccacatggctggggaagccttacagtcatagcggaagacaaaaggcacatcttacatggcagcaggcaagagagaatgagagccaagcagaaggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaagaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaatcacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcgcctggtatatccatcagagaccaccaatgtgttcctgtcaccccaacaggaagcagagaacccaaggctgtgttggcaagtagaagaccctagggacccagagggcccagagagcccagggattcccagtgcaaaccctcagatgccttggtgccttaaggaaaaacacaccagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttcatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagattgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaaaaaaaagagcaatagaaagagagaattggatgcatgctataacagcctatgatggtagatccagctggtctggggaaaaaggagagtatccaactaggcttccccaaggtcatgaatttttttttttttgagacagtctcactctgtcacccaggatgaggtgcaatggtgcaattacagttcactgcagcctcgaccttccaggctcacatgattctcccacgtcaacatcctaagtagctgggactacaggcatgcagcaccacatgcagctaattttttgtttttttttttcttttggtagagatggggtctcacttcattgcccaggctggtctctaactcctgggctcaagcgaacctcccacctcggcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggtaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccattacctatgacatcttcctctgaaataagctcaacagatgatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccaatagttttctcccagtggagttagaaggatagctcctaatgctctgtattagtctgttttcatgctgctgataaagacacacccgagactgggtaatttatgaaaaaaaaaagaggtttaatggactcgcagttccatgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacgacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttgtgggtagcagagtcaacaaatggacgaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcctgggctaatgctatcctcccatctcagcctcccaagtagctgggggcatgcaccacatctggctaattttttgacttttttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgccagcataggtagaatataagcaggcagagcagcatagaagggcttgactggctgagtcttccagccttcatctttctctcgtgctggatgcttcctgccctcgaacgtcggactctgagttcttcagctttgggactcttggacttttgaccacagactgaaggctgcactgttagcgtccctacttttgaggctttgggatttggactggcttccttgctcctcagcttggagatggcctactgtgagacctcacctggtgatcgtgtgagtcaatactccttaataaactccgctttttatatacatctatcctattagttctgtccctctagagaacgctgactaatacactcccatacggaggggcaagggacagagcctttgtaaccctccaggattatgggatgcctaggaggggaggaggatttcccagcactaggtggcttcctgcaggtgccttcttgccagaggcaggactttgctatgagctgttagcagctaggtctcccagcagctggggggacagagggcctcggtggtcctgcacagaggtctgagtggtgcagcacccacagcgaagccagtgaccaaagtggaaagataaagatatgaaaatctttcaactaattaagatttaaaactcagattgatgtgaggatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacggttcacacctgtaatcccagggtggccaaggcaggaagattgcttgagcccagaagttcaaggctgcagtgagctatgatcatgccactgcactccagcctgggtaacaaagcaagaaaaaaaaaaagcaagaaaggaagggagggatggaggaaggaaggaagggagagagggaaagagagagagaaagaggaaagaaagaaaaagaaagaagaaggaaaaaagaaagaagaacgaaagaaagaaaggaaggaaggaaggaaggaagaaagaaagaaagaaagaaagaaagaaagaaagaaaaaaagacagagagagacagaaagaaagaaagaaagaaagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgacgggggtgatgctccctccaagataacaaagaaaacctggccaggcacagtggcccacgtctgtaatcccagcattttggaaggctgaggcaggaggattgctagagcccaggagttcaagaccagcctgggcaacatagtgagacccctgtctcttaataaaataagaaaaaagaaaaggaaaccttccctttacatgaaggcatcataccttaaatgcacatcccatctgcccaggaggctcacctctagatttgtatcctactgatgaacacacaccaagatggacatactagcataaattgtggagaatgacagaaaatatcctgaatgtccaccatgagggaactgattaatttatacacatccgtatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttttgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttataggcatacaaactaaattaattagccatccctatagcttcaacatgcatttcaatttgcaagcaccctggcctccaagattgattgattggctgtaaattgagaacctcagcaatttcctttcacagggacagatgttgacattattcctgtgatttttcacagatgtttcccttccagcatctttaaaatcgagttttctgtcaatttggaaatcccaaatttctcatatcaaatcgagatgacaggaaaatcaaaaccgttatcacattttgaaagagtttatggatggcaaatgacactgggaagggagatgtttaaggagcagccgacgtctcttaaccctttctcatcacttcctgcctcagtttacctaagccagcaaaaggggaaatttgattcaatatacagacaagggctttagagtctgcgtagcggtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgttttttcctttttttttccctttccctcctccttcaccaatcctccaagcagcttttcttccttcttcatgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtgacaacaggcaggaatatgatctactcatacaaaccaaacctctgctgtttgtacatcttagctaataatgcccaacacacagccaacatttactaagtcaggctcttgagagccacttcatctgcatgacgccacaaaatcctctcagcaacaaaaaggcactgttattatttctgttttagagatgtggaaatgagcaccagaagtagatgtaacttgacaaatatctgggtggtagatctggaaatcaaagaaccctgaaccccaaccacagacacatcttcagttcaggctgggtctctacgctttgttatttttaacggggcattacgctccctggatggctatgatgctgcagttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgtgatgtgtccatattagaagagacaccagagatacctttctctctctctcactcttgcttgatctctccctctctctcttgcactctctctcatgcttgcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtctttcctccaaccaataatagatggcttgtcctttccatcgcccaccttgggcaaggcaaacaggacagtgaaggcaagcacatctcacagacaccagcattcatgtgctaatgaggctcactactagtattgcaaagatgggaagtcaaacagaattatgtccttgcgaacatacaataacttggaaaattttattgaaagacattaagtttgcatacacacaaaaatgagtgaagagttttttgttccattgaataatttagaggacatctaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatattatcaccgcctgtattgattggggttttccagagaaacagaaccaatgtctaaacagagagagagatttcacgcaattatggaggctaacaagtgctgtcatctgcagggtgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaactagctgtgcacctgtatccctaagagttaacacataaaacctaccatcccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaacgcctgcccagctgcagccaaacgttccatagacaatgtctctgggccttttgtggcagaaaaaccaacataaggaaaagaaggctggagatgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctacccaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaatcagctgggtgtggtggtgcacacctgtaatcccagctctttgggaggccaagacaggtgaatcacctgaggtcgggagtttgagaccagccaggccaacatggtgaagtcccatctctactaaaaacacaaaaattagctgaacatggtggtggacacctgtaatcccagctacttgggaggctgaggcaggagaatcacttgaacccaagaggcagaggttgcagtgagccaagactgcgccactgcactccagcctgggtgacagagcgagactctgtccaaaaaaaaaaaaaaaaaaattctcagacaaccagcagtgatacaagagataaaaggcatctggctttacgctgcaaacaaaagggaaacaggaagtgagagagcagttggcctctaagaagcatccatttgttttaccctgccaggtgcctacaaggtgatggttttgcctcccaaatataatcaggggcccaatctctgcattcagagaagtatatttcagcaacccataagtaatccaaaagcagttccccacacatcagctcaaacagtgttacaggacaggcattcttggtgccatcagatccaatgtcccatgttttaaccaacaattgaaaagccctcttttttttttgagacagggtcttactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaaatgtgctgatcctataacccatctactcttctaaccaatcacaattgtgccctaattataataaaaaggagaaatgaaatgatgaggatttctaatgaaataatatatagagaaatgatatgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccaaggtgggccgatcacaagatcaagagagcaagaccatcctggccaacagggtgaaaccccgtctctactaaaaatacaaaaattagctggacgtggtagtacccgcctgtagtcccagctactcgggaggctggggcaggagaatcgctggaaccagggaggcagaggttgcagtgagccgagatggcaccactgcactccagcctgggtgacagagtgagactctgtttcaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacaaacacacacacacacacacacacacacaaacacacacacacacacacacacaaacacacacacacacaaacacacacacacgggacaattcagtccccagtgagaacctctgtaataaaaggtccaattcctaacccgcaataatattcttttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgcgttagccaggatggtctcgatctactgacctcgtgatctgcccgcctcagcctccaaagtgctgggattacaggcgtgagccaccacgcctggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtgtgataattaaggtaattatttagaccaggaatctgcaaaatacagcctgaaggccaaatccgagctgcttgttttcctatggcctgaaagctaagaaagaatggttcttacattttatattattattattattattattattattattattattattattactattttgagatggagtctcgctctgtcgcccaggctggagtgcagtggcaccatctcagctcactgcaacatctgcctgccaggttcaagcgattctactgcctcagcctcctgagtagctggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgtactacaatggcagggttgcatggttgcaagagagcacatggcccccaaagcctcaaataatccactatctgggcctttacagtaaggttgtcagcccctggcttaggcactaaacaagtgctttcaagcacctactatatgccagacactaaggtaatagagaggggagacaatcaacaagaagcattctttctcaaaagttttaggctaggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagttaattaattaattaattaaattaaaagcatgttattcagaatcacatagacttgggctcagctcttcagccataagcatgtttcttttctctttttctttttttttttttttgttgagacagagccttgctctgtcacccaggttggagtgcagtggcacaatcttggctgactgcaacctccacctcgtgaggtcaagcgattctcctacctcagcttcctgagtagctgggattacaggcacgtgccacgatgctcggctaatatttgttttccttttttttttttttttttgagacggagtttcgctctttttgcccaggctggagtgcaatggtgcaatctcagctcactgcaacctcctgccttccgggttcattcgattctcctgtctcagcttcccgagtaactgggattacaggtgcatgccaccacacctggcctaatgtttgtatttttagtagagacagggtttcaccatgttggccaggctgatctcgaatgctgaacctcatgatctgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgctacccccttcaaaaataataataataatatgaaagttgggaagtggaaaaccatcctctggagttttcaaaaactaattccattgtaatcatagaagactgaaggcaggattcatgacacatttctcttcctcctgggcagatgaatctacaatttgtatttgattttaaatgtgattctcctgcatcttcagtgggtttgattgatagagcacatggggccactcagtaaaatgatacagtggagatcaaagccggaaagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcgtaaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccctggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacaattgcttgtcaaaaaaagagcctcatcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccactataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgatgggaggttggatgaatgaataaaggagtgagaaagttaattgcttcccttctctgggctgctgtatcaatcaaggttgtggcaggaaatacatagtaaactgaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcgagtgctggaaacttaatccctgatgcaaccgtgttgagaggtgaggccttcaagaggtgtttggatcatggggacatcatctttctgaatggattaatgcctttatcatgggagcgggctggttttcacaggagtaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgctcataagagaaaccattctccaaagcccagagtaattatagagcccataagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccttttccttccacctggaggttagcaggaactttcaaaggtttagtgtcatccatatcccattgtcttcttcatgcacagaaaagacaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgagatatgcatgtaaagtgcttgatataatgcctgacatggaaaaaacactcaataaacgttagtcatcagtatttatatcatcattccttttaatacacgccatcgactgggtgcagtggctcacgcctgttatcccagcactttgggaagcagaggcgggaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggcgcggtggcttactcctgtaatcccaacactttgggaggccaaggtgggtggatcatgaggtcaggacttcgagaccagcccggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgcactccagcctgggcgacagagcaagactccatctcaaaaaaaaaaaaaaaaaaagaatgaataagacctactatttgctagcacaatggggtgactataatcaaaaacaatttaatcgtacattttagaataactaaaagagaataattagattgtaacacaaaggaaaacgcttgagatgatggataccccatttagcctgatgtgataattacacattgcatgcctataatatctcacgtaacccataaatatatacacctacgatgtagtcacaaaaactaaaactaaatataaaacaacaagcatttatcatctaattgtctggatttggaacccacaagccaactcagctaagtgctctggcttagggtctccaatgaggctgcaggtaagatgtcagccaggactgcagtcatctgagcgtttctggggctgaagactaggcttccaggctcactgtgtggttgtctctattccttactggctcttagacagaaacctcaattcctcaccacgtgggcctctccataaagtgccttagtgtcctcaaaacatggcagctggcttcctccaaagcgactgatccaagaaagagaaagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgaatctcgctctcgctgcccaggctgaagtgcaatggcgcgatctcagctcactgcaacctccgcctcccgggttccgggaattctcctgcctcagcctcagcagagttccccaagggtacctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttcttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcaaactcttaacaaactatccctgagaggaaaagagaatgaattcatactctgtggagtgtagcccaaaataacctctgcaaaggtgaaattttctttgaagtcttattttaccttaggtatttgtgaactctgcgttctattttgtgccacatgtgttttaagttactattactctactaaagtttattcatcctccaggaagatgatgatgtttgtactgtagttttttatgtcccagggatacagcagggttccccaagggtatctgttggcctagtttgagactcttggctctgttagtgggagtctcaaactatgctccaggctgctgattgttctgagggatttctctttctttctaacactaagaaataggaaacacagttttcagtttaaaaataacataattacaaagtgtagaaaagtctctcttggccgggcacggtggctcatgcctgtaataccagcactttggaaggccgaggcgggtggatcacgaggttaggagtttgagaccagcctcgccaacatggcaaaatcccatctctactaaaaatacaaaaattagctgggtgtggaggcaggcagctgtaatcccagctactcgggaggctgaggcaggagaatcccttgaacccaggaggtggaggttgcagtgagctgagaatgcactactgcactccagcctgggcgacagagcgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgtttttgtttttgttgttgttgttttttcagagagagtctcactctgttgctcaggctggagtgcagtggtgggatcatagctcactgcagccttgaactcctgggctcaagcgatcctcctacttcagcctccccagtagctgtggctacaggtgcacaccagcacgccttgctaattcaaaaaaagaaaaaaaagaaaagaattgtagagatggggtctcgctatattgcccaggctggtctcaaacttctgacctcaattgatcctcctgccttggcctcccaaagtggcaggattacaggcataatccagccattgtccctggcctggctttttttttttttttttttttaatgtagctcatgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgaccgtgagtaagttcttaccctctctgagcctgtttcttcacttggaaaataaaagtatacacatatacagctgttagccagaactcagcctagggtaacctttcaataaatattagcatcatcaaggaaatcgcttgacaaattaattttcattaagcaatgagggtctataacagtgatgacttctgaccaaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagaacacagctactggaatcagaggcagaggagctcctcttgcgttcgttgttggtttcccttggttttgtaaaaataaataaataataaaatagggatacacccttcagacagcaggtaacttcctaagctaagatgaacaggaggaaatttaaatgtctttccccggttcaaatcccctaccctctcccatctgcctaccctgggctccaacactcgggagaaagaccataagtcgttcagatgatgctttggagctggacaatcaatcgtgatcaaaaacaggggcatgggagcctggctaacgtggagggatgggagaaaatcaggctgaattagagaagggtacattgtggagtgtgttttacaacgccattagttctaagcacataaggatttcaaatcaaggagcatccacacacacacaaactcttggattccttaagagataaggcggatccaaaattagcatatagatcagaggcatgcagttgagtgctgctaaagtgggctataaatgcttgggggaaaatagttgtttttctgaagaaactttacaacattccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttatttgcagcctgatatggttcggatttgtgtccccacccaaatctcgtgtcgaatcgtaatccccagtgttggaggaggggcctgggggaaggggattggatcacggggacagacttgccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttcctcagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcactattgtgtcaccttggggcaagtcacccaacttctccaaatgtttgtttcccaccaggaagatggaaatgacagtacctctccttcctaccccgcaaacctatcaggaggatcgaaagggacatggcaagcaaatactttctaaactgtaaagtgctgtgcaaatgcaagacagcattactctctttttatggagttatttatactctacctggttacagcagaggatttatggtagatgtcagtaagactctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcctactaagtgcagtacccagcacgatgtctaacattgaaacatacagtgtatacaccagcacctccaccaaacccatatccagcatgcaaaacatacccttttcaagtcggaagcacatagatagattttttggagttcaaaaggtcttaatgcaaactggctccaattccttttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccaaaactaaaagctctttctttattgctatttctttaagtcctaacaattggtcaggcacagggtcttagctgtgccattctagttaatggtcggttacaaatttccaccataaactcatcttccttctagcaacttaaatctcaggcactgggatgtaataaggagagaaagctcttaggcccagggcaatctctctctcaatcccaatctcccttccccccatccctatcccaccacagtaactgttagtaagagcttttggttgcatgcccagaaatctaactctggctaaattaatcaagaaacgaatatactggtttacccagctgaggtcatttacggaaagggaatgctaaggtttgaatgtgtctcctccaaaattcatgttgaaacttaatccttattgcagtggtattaagaggtggggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagtaaggaacagagccccttaccagacacaaaatgtgcctgtgccttgatcctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctctctctcgctctctctctctctctctctctctctctctgtctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagagcctgatgtttgaccagatatgtgccacttaccaaccatagcagacactggcaatggccacccatgtcccttggaccctccccatcccatacaagctgaaggcctccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacactttgaggtgtgttccatgccatcaaccaaagcccatcaaaaggaccaagccccggctgcccatagaagtaacttactcattaccttgctctattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatcggtagacggaggaaagcaggttgcactccagatgtgcgtggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacggctctttctggatctcaagcctgctggttttcagactggaactacaccactgggtctcctgggtctccagcttactgactcattctgcagatcttaggacttgtcagcctccataattgcatacacacacacacatacacacacacacacacatatatataaaagtgcatatagatacatatatgtatgtgaatgtatgtatataaaagtgcatatagatacatatatgtatgtgtatatatatatacacacatacacacacatatatgtgtgtgtgtgtgtgtgtgtacatatacatgtgtgtatatacacacacacacacacacacacacacacacatatatatatatatatatatatggaccatagagaagtctctaagccaaagctggggacaggggaatcctgtgtctccttgggagaggtctgctttagtgtccctgccatgctcagtcattagccaggagcacctcatggaaggaagcatatggattccccatatgcttatatatgtgtgtgtgtgtgtgtgtgtgtatatgtatatgcatatgtgtgtgtgtatgtgtgtgtgctattctattggttctacttctctaaagaaccctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagagcacctaaacaaaagggtattaaccaattaaaataacctaaacccacacttgtccaaattgctgagcaagtgggatgggatgaaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaacttaaatgcacacatgggcagacaagtaacacaaatgagtgaagagtacagattagggcaactgggtctggtggagactgtggcaaactagagagcacacaccctatctaaggaggcagcgaggactcaattttgcaagatttgtggaatggactcccaatgttgccaaactgccactattttttaaagagaagcaggaaatccaggggtttttaaagatgtaaaatacacagtttgttgaatgctggcgactgatttttttttttttttttttgagacaagagtctcactctgttgcccaggctggagtgcagtggcatgatctcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggggttacaggtgtgagccacagcacccagccctgattttttttaatgtaaatactgtatgaacccagacaaatgttctgccaggccagtgctgcatggctcaccacgtggtggccctgagaatgggcctcatcgacctgcctctactgggagtgtaattaaccagggccccagctgctgcgctggggaatccatatgcttccttccatgaggtgctcctggctaatgactgagcatggcagggacactaaagcagacccctccccgggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaatcctgtatgggagtttgtttctcagaactgggctgacacaccatcttgcaaactctgctttcggcattcagctcacacttacttacaccctccaaactccaactatttagggctaattccattccagctcccacccgttgaatcccttccccctccccctgcttcctcctcccattctgctttcctggaaacagcatttccacttacttttgaacaatggtccttccttcactgttcattcatggagtttggatagcaccatcttctaaagctagggctgagcacatgatcaggactgactaatcaccctcttctacttccttagccacaataattcgttcagagatgggcacctgactcttacaatgcaatgagagtcagcttcttatgccagtgcttttggcaaaggtaagttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaaaaatccagcacataagtctaggagcattgaacaagggtcagattgcatggattcagattccagctccattactaactggctgtgtgaccttggacaactcaattgacctctctggccctcagtttccttatcagtaagacggaaactccaatcatatctattgcacgggatagttgtagaaattaatagatacataagtgcttagtgcaacatgtggcactcaaaatatgtgtggtatgattgttattgacacaatgtttgacccatgaatgattgtgatgccaaccccctcacagttggaaatccacctataacttttgactcccccaaaacgtagctactaatagcctattgttgaccagaagtcttaccaataacacaaacaatagacacatatgttgtattttagatgattatacactgtattcttacaataaaataagccagagaaaacaatatatgattaagaaaatcataaggaagagaaaatgtatttgttattcattaagtggaagtggatcatcataaacgtcttcatcctcattgtcttcacattgaggagactgaggaagaggaggaagaggaggaattggttttgccgtctcagaggtggcaaaaacagaaaaaaatccatgtataagtggacccatgtggttcaaatccatgttgttcaagggccaactgtatttatattacaataaatgctgttaatgttgtcactgttgacccttctattccattcccaacatcacttcctatgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacgtcaagtatgaattactttaattgccccagaagaacgcactgttgaaacatttgacttgcccagaactaattgtctgtcaaaaagatattttgcagccaagctgatctcttaattggacatctaatttaactgaaaacctttttccctgcttgttttatgctttcttctcctgtttttgccaaattctggatgctgggcactgctttcagaaataatttatcttgttattttctattataaaagtaatacatgttcattatagaaaaactgaaaaaaaaaattccacatgaagaaaaacagtggatcctagactcattgcccagaggaggactatgaacattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaagactattaacattccacatgaagaaaaacagtggctcctagactcattgcccagaggaggactatgaatattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaggactatgaacattccaaatgaagaaaaacagtggattctagactcattgcccagagaaagactatgaacattccaaatgaagaaaaacagtggatcctagactcactgcccagaggaggactatgaacattccaaatgaagaaaaacagtggatcctagactcattgcccagagaaagactatgaacattccaaatgaagaaaaacagtggatcctagactcactgcccagaggaggactatgaacatcttagcaagtctcccctcaggttgtcctagaatagatgtctctacgtagttaataaaaacatacattcaagttttgcagctttttgttccactttacattttaagttgaacgtttacacttcccattccaagatcttcagaaacatgtttagaaacagaagaatatcccaacaacagtctgtttaacctcttcccctaatgctgaactattgttgctttaagcatacattttctgtgtgtgtttcagatgtagtttccttaggaaagattctctatgctgtgcaacaattccccatgtgtctcttacatttctgcacatcttgtgtcagcatttgttctagaccgtctttataaggatgtttgtatagctaatagcattggaagatagggctaatatagtagaagacagatttatttgctgattaggattataataataatatctccggaccaggcgcagtggctcatgcctgtaatcccaccaatttgtgaggctgaggcaggcagatgacctgaggttgggagttcgagaccagcctggctaatatggtgaaacccccgtctctactacaaacacttaaaaaattagctgggtgtggtggtgggtgcctgtaatcccagctacttgggagacaggtgggagaattgcttgaacccaagaggcaggggttgcaatgagctaagatcataccactgcactccaacatgggtgtgacagagcaagactctacctcaaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccgtgtattactcatttctcacactgctaataaaaacatacccaaggctggatgtggtgtctcacacctgtaatcctaacaccttgggaggccgaggtgggcagattgcctgagctcaggagtttgagaccagcctgggcaacatggtgaaacctcatctctactaaaatacaaaaaattagccaggcattgtggtgcacacctataatcctagctactcaggaggctgaggtgggagaatcgcttgaacccgggaggtggaggttgcagtgagccaagaatgcgccactgcactccagcctgggcgacagagtgagattctgtctcaaaaaaagaaaaaaaaaaggctaggcatggctgtaatctcagcactttgggatgctgaggtgggcagatcacctgaggtcaggagttcaagaccagcctgaccaacatggagaaatcccatctgtactaaatatacaaaattagctgggtgtggtggtacatgcctgtaatcccagctactcaggaggctgaggcaggacaattgcttgaacttgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagaaaggggaagaatgagcaaaagaagaaaaagccccgtataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatatgagtcattgcctgaaatctcttttgtcctcaggaagggatagagctgcttgactcagatctctcaggtggccttagactgtaatgtcttcctttcgtgcagagctcttaccatcctaagccactacacctacctaatattctataaaaagctttttctccctacccagtgtctccaatgagctgactttcttttctggattactcttttatgtaataaaaagtagacatgagggtcaaacagaaagggaaaaaggggaatttgtttaatttctaccaagtgccaggcatagtacaaagaacatttagataaggcagaaggcattaattatttttatctacccagaacccactgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaacccaccatggtaaaaaaatacatatataaaaataaaaaagatatgaaagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaacgagatagcaatcatgtcctacataccccctttgagctcggtattcatttcttaaaactgcttgccattgccacaagtagctataaattaatctaataatgccccactggatgctataacccacacctcatagcttaacaatgtatagccaatcactcgtcaatgttatttctgaaaaccagtgagaattcctggcaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactgtctctctctctctctctctctctctctctctctctctctctctctatatatatatatatatatatatatatatatatatatatatatatatatatatgaatttgaagcccttcaaccatatggatcatatcttgaagccctaaccccctagcacctcagactgtcactgtatttggagataggggcttgaaataggtgattaagtttaaacctatttagctcatttagggtgagctctaatccaaccagactcatgttgttataggaagaggagattaggacacacagagagacaccagggatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacaggaatccatcaccacttatgacaggctctgccacatagtaggtgtgtgtgcacacaccacacacaaacatgtttagaatatgaaatccgtgaaccctactcccacactgataacagttcaggaacagttgattttccctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagtgtgtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacattctctgagaggaagatacccaaagcttcaagctcacctcaagggaaaattgagctaggtttccatgctctccacttggatctcacgcacatgaacacacatacaaccttctcctcaatattcacaagaggcctctgttgtctgcttctccagagagcggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaattttttttttttgtagagatgggggtcttgccatgttgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattataaaagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgagggccataaaggctccaagctagatggatattgggggagtgggttagcagagatgtcctaaaacaatgaattacactaatgggaagaacaaaaggtaagtctaatcacagatgtcttggttttcaagctagtcagacttcagataactgtcaaatcttcagccataaatcgaaagtggaggagaattaaagatccatccttgtttgcttacagaatttacttaatttagccactctatccttaattgatagcaacaggttttttcaaaatagtcaaagtaatctatgctttgctacataatagcaaaagtaatagccaacattcatcaacacctactatgttatacccttgacagggtttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgtgttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactctgtctcaaaaaaaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatggcagcatggttatgagcacagactctggagcaagaggtcctaggttcaaatcccagttaccctgcttatcagctaaatgacttctcagtgccttggtttctccatccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaatgccacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaaatggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttctttttttttttttttttttttttttttttgcgatggagtctcactctatcacccaggctggagtacagtggtgtgatcccggctcactgcaacctctgcctcctgaattcaagtgatgctcctgcctcagcctctcaagtagctgtgattacaggtgtgcgtcaccatgcccagctaatttttataattgtagtagagatggggtttcaccatgttgaccaggctggtcttgaactcctgacctcaagtgatcctcctgccctggcctcccaatcatggtgggattataggcttgagcccctgtgcctggcctagaaagctaacttcttaattgcaagctactttcatcaatataatgcatttgtctcactccttaaaggactcctgtcacagtggattggcaaagaacaggtcagacacaagaggcagtggagtattagtaaaatacacgtggatttggagtcagaccttcctaggtttaaatgctggttttatcgcatactagttgtatgccttcattggggtttcccaagaatcagaccctgagacaagactccaagagtaagtcatctatgtgggaggtaaatgaaacatgacacaggaaatgaaataggtcagggaggcagccagtaaagggcatattataaaacaagttactacttgggacaataactggaaaacttgctggaaaacttgctggaaaactctaggatacagtgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtacttatccacatacaccaactctcatcagttcctggtggagggatgctcccagggcaggtgttgattcctccaagacttccaagccatcatacgggtgggcaaagacagtacaaccagaaaaagacctcagaaagagggccaggcatggtggctcacgcctgtaatcccagcactttgggaggccgaggtgggcggatcaggaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaatagctgggcatggtggtgcatgcctgtaattccagctactcaggaggctgaggcaggagaattgcttgaacctgggaggtgggagctgagatcaagccactgcacttcagcctgggcgacagagtgagactccatctcaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatactcatggagcacttagtatatacccagcaatcttcaggccataggaaacagaatgttgagttaccatgacaaagtcactgtcacagagccagtggggaaagcagcctctaaacatgccacccagtaagtaacaaagatcatttcgggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaagcaggtaaccaggaaacagagtggaggggcaggcaggaatcagtgtctgcagtgcgtgctcagcatcataaagggtttgggtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggtaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcatcatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctggatgctatatgtgttatatataacatacatgttataatatatgttagatatgtatgtcatacatatcataatatataattatacattgtatattatatattatactattacatataatatataattatacattgtataattatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatatattatatataatacatagtttatatgttatataacatatataacaaattatatattatataacgtgttatataatataacatattatatattatataacgtgttatataacaagttatgtaatatacaatatgttattaaaaagatattacagaatatattaaataatgtatgttttatatattatattatatatgttttttatatattatataatatatatgttttatatatattatttttgttttttttgttttttgggggttttcttgagacagagtcttgctctattgtccaggctgcagtgcagtggtatgatcttggctcacagcaacctccgtctcccgggttcaagcaattctcctgtctcagcctcccaagtagctgggactacaggtgcccacaaccaggcctggctcatttttgtattttctttagaggcaaggtttcaccatgttggccggactggttctcaactcctgaccccaagtgccccgcccaccccatcctcctaaaatgccggaattacaggcatgagccactgcatccagcctatatatgttctttcatcatcaccacatcatctaattttacagatgagaacactgaggcttggggagatattaaatgtcttatccagattgcatgcatgtaagtgacataagcacgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgtataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttgggaaaggtttctatcattagacctctcttttcccccaaccagccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaattttttttttttttgagacagtcttgctctgtgtcccaggctggagtgcagtggcgcgatctcggcttactgcaacctccgcctcccaggttcaaacgattctcctacctcagcctcccaagaagctgggataacaggtgtgtgccaccacacctggctaatttttgtattttttagtagaaacagaatttcatcatgttggccagacttgaggtcaggtcttgaactcctgacatcaagtgatccacccgccttggcctcccaaagtgctgggattataggtgtgagccaccgtgcccggcccgaagatcacaattcttatctaactctgctattcattggctgggccaccttgggcatgtccattagctttctggttcttaggaccctcatgtctaataacaaggtctttcctacctgccccacagggctgttgtgaggaccaaatgagatcaagaatgcaaaagctctctgtcaactgtgaaacactaccaggagtaaagattcacaaggcatgagttgccacaaggcagtatagcatggtggttaggaggttaagctcttaaaccagattacttggattccagtataaccccaggatacttaactttgttttgtggtgttgttgttttgttggtgttgttgcttggtattttgtctaattttcagaaacagggtcttgctctgttgcccaggctggagtgcagtgggcatgatcatagttcactgcagccttgaactcctgggcttaagctatcctcctgcctcagcctgtggagtagctgggactagaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtattggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgctgtgattagtgctcaaaagcataaagcataactggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctgtccaaaaacgaatttaacttgccttccaaataattttactcctaatttttagctcactttctccatgaatatcatcgccattcacccagttacccaaaccaagagcctgaacaacatctttgagtccttctccatcacagcctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaattcacatggcttgggtagcttcatgagagactgggaaattagagggttttggttttgttgttgttgtttaaagcagagtctatgtcaccctaattaaaatcagtgtttcatcttttattcttcctcaaatattctgtgttaaagtcactaaagggcaccaaccaaagtaagcatcaatgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcgagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcgtattatgggcatataggagaaggtccttattgcaagaaacacacagtaaagtattgggaaatgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagagagaaagccatccacgtgaagagcaaggagacaaagttttcaggcagaaggaacatgtgagaagtagctgaacttgttttcagagttataaccctagcaatatggtggaaaataacaaataactagcaatgtggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagtgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagttgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagaaagcatttgaaacatgctacaaatttgcctgtatcctacattaaatggatttttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttttttagaaggagtttcactcttgttgcccaggctggagtgcaatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatggttgaagaagcaataacttaccccagtgcccccaaggcaagttgtctcaataatgtaacaaagctatacttaatggcaacagagcacgtttcactgatactacaccgtaaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccgtgaccctgcttttgagacccctactctctctcccttccctattatctcttggtgaatattggggaatggctcacctgaactgccccacgatttcatgcctctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggatcgaagggggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttctggccttcatctttctcctgtgctgtatgcttcctgccctggaacattggactccaagttcttcagcttttggactcttggacttacaccagtggtttgccaggggctctcaagcctttggccacagaatgaacgctgcactgctggcttccctacttttgaggttttgggactcagactggtttccttgctcctcagcttgcagatggcctattgtgggacttcaccttgtgaccgtgtgagtcagtacccctgaataaactccccttcgtatatacatttatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagaaagacataaatattttttaaaaagaatcagaaacgtatgccccaaaatgctaatatgattacatccgggtggttaatatttattttctgtttctattctctttgtgtttccccaaatttgcttgttgacagaacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaaattagctaggtgtggtggcacgtgcctgtaatcccagctactcaggaggctgagagatgagaattgcttgaacctgagtggcggaggttgcagtgagccaagatcatgccactgcactccagcctgagcaacagagcgagactctgtctcgattaaacacacaaacacacacacacacacacagttatcttgatggcagttcaggaacttgggagatgagggctgttctcctaaaaccctataagaaccctcaggtgggttatgccacccattcactaatatcccatttacgggtgaagggaaaggtggaggagaccaaccaacccaccagcagtggcctcagtctcaaataaaacttagtccctgagttagaagccaacttaaccatggagaggaaagagttcatcagatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgccttagcaaaattatgactgagacagtgaaagagatttaacttgatcaattccatcttgcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatgagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggtcacactctgtcgagaaggaacacagggagttgcggaaggcttccagaggaagtgcctgggctttgaagaatgagcaggcattaagtgggcaaaagagcatgtgcaagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaacataaggtggtgggatttcagttgaaaaggtgtccagggtcggcctcgggtcagtctatctttgggtctatcacaaacactatattaattgcccctattaatctttcattatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaataaagtcacagtgacacggcaatcaggagtggcaagggagccacagacacacatgattagacacaaaaatcatgttttcaaggcacagcccacttagagatcacagcaagatgctttatccaacctccgccggcaatcagagcttgaaaaaggagcattgtcgtcaatcaacttccctttgggcaaaagacacaggcaaaggagaagatacttcacccaccttttaataaatgtgtcttgaggagagagttggcccacatagtacagtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgggaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaacaggaaccacaaatgaaaatccttgcagagagtccaggcagataacataagtgaagaaagggaggaatgagaagcagtagggaatggtggggtctgtggtgaattggagtgcatgcctcattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaaaccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgataggtctctttccttcacaggctgagacaactccaattcaactctgaatccccaatacaggacctgcccagggaacagggctcagacatttatgctgggaaatactcagcttttggggctcagcgtccttttctgcaaaaagagttcccctcccaagaggaaatcccctaagcctaaggacaggaggtgatggaaagatggatggacgggcagatagatggatggaaaaaaatggacagttggaaacagacaaacttggtggatgagcagaaataagcctcattctcgcctaacaacgggacagcctgggggaggggtgggacacaccaaggctcccagttgacccccagcaattggacaagagagtttataaaccagcattggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcaaaagatacggttgattctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtttgagccaggagttcgaggctgcagtgagctacgatcatgacactacactccagcctgggagacacagcaagaccctatttaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacacggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccaccactccaggcctctacctgggccctttaatgccccttcctcattcctcaagagcccactggcgtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgcgttgctcacagttctggaggctgggatgtcccagatcaaggcacctgcagattcagtgcctggtgaggagggctcactctgcatcataggtggtaccttgttgccgtgtccttatatggcaaaagaggcaaaggcgcttgctcaagccccttttataaaagggggcactaatcccattcatgaaggtggattcctcatgaattagtcacttcctaagggtcccctcttactactatcacattgggtattaagttccaacatatgaattcaaggggaacaatgacattcagaccatagcaccagacgtctatctggggaagcccccaaatatttgtctttttttttttttggaggcagggtctgcctctgtcattcaggctggagtgcaatggtacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcccctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacaactggagaggggctctcacagggtccatgggaagagaccaaggaggggcatggaggagaggggagggctgagaagaccagggtgaaatggatgaggagaaggaagcagatggcagggaccctcccatctcccacatgggctcccttaggtgctactggccttgtgcaaatttgcacactcacattcacacatttctgtctgcttctctccaatcgttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaggttttggggaggaataaatggcatagcagatgggaaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctccttttttttttttttttttttttttttagagaccgggtctcattatgttgcccaggctggcctcccaaagtgctagaattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccgctagaggagccatctcagaaatgaattctgcagccccctggtgagctccagctgatgccatgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcggctctgcaggaagctgtttttgcacaaggttcttccacatttctgggaaccaggagatgtctacttcagctacaatctctcctgctcgtcccctgtcccctcgggagggtctggctcagaacagatttcactgtgggacccaagccaacctgttagccactcctaccccaggacgggtgaaacacagtcttgcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacccagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcaggcgctgcagtccagccagcctggatgacagagagagactgtctcaaaatacaaataaaataaaataaaaaaagaatgagactcttcttactgcaaaaactgacctctggggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccgtctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactatatttttttttttttttgagacagagtctcgctctgtcgccgaggctggagtgcggtggcgctatctcagctcactgcaacctctgtctcccgggttcaagtgattttcctgcctcagcctcccgagtagctgagattacaggcaccaaccaccacgcctggctaatttttgtatttttagtagaaacgcggtttcaccgtgttggccagggtggtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaatctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcccgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaacaaacaaacaaacaaacaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttttgacggagtctcgctctgtcactcaggctggagtacagtggtgcactctcggctcactgcaacctccgcctcccaggttcaagcaattctcctgcctcagcctcccaagtagctgggattacaggcgcctgccaccacgcccggctaatttttgtatttttagtagagacagggtttcaccatattggccaggctggtctcaaactcctgaccttgtgatccgcccgcctcggcctcccaaagtgctgggattacaggcatgagccaccacgcccagccctttttgctttttttttttttgaaacagggtcttgctctgtcacccaggctggagtgcagtggtgcaatcttggctcactgcaacctccacctcccaggttcaagcaattctcctgcctcagcctcttgagtagctgggagtacaggcatgtgccaccacgcccagctaatttttgcatttttagtagagatggggtttctccatgttggccaggctggtctcgaactcctgacctcaggtgatcttcccgcctcggcctcccaaagtgctggaattacaggtgtaagccaccacgcacggccctttatcagtattattattattaacttttactaaggaaagagggaggcccttggccaggccgtaggattgctggccttccagggagtgtgttacccagggaagtggcataaaattacagaattgggaagctaagaggtagctctagacatcacacctctaacctttttgatattctgttgctccatctacaaatggcatttagaatttttgttcttaaagagtcacaaatcacgtgcaggaagcttgaaaccagtcctgttaccttcctatgctctgatgccacctgggaatttgagctggtgtttcgggtaagagaacagcttataaccaggcttttcaggacaatgaagactgcctttcagtgggaagatgaacaatctgcctaagtcataagaatgatacaatggactttggggacttgggggaaagagtggaagggggtcgagggacaaaaggctacaaatatggggcagcgtatagtgttcagatgatgggtgcaccaatatctcacaaatcaccactaaagaacttactcatgtaaccaaataccacttgtaccccaataacttatgggaaaaaaatctacccaaggaataaaactaaatcgagactttaaaagcgagacattaaggaagttgactcttagctgacctggacacaggcctatcatggtaagtgctgcaggtgaacaaacagcagcaatttgacccttcttccttatacatcaaattcctttttttaaaaaattatttttgagacagagtctcgctctgttgcccaggctggagtgcagtggcacgatctcggctcactgcaacctctgcctcccaggttcaagcaattctcctgcctcagcctcccgagcagctgggattataggcacccaccagcacgtccggctaatttttgtatttttagtagagatggggtttcgccatgttggccaggctggtcttgaactcctgacttcaggtgatccacccactttggcctcccaaagtgctgggattagagacatgagccaccgcgcctggcccaatttcatttttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattaggctctccccagtttcaggggatgaatcttgagcagtctgatggagggctggcaagccattgcctaaacccggcccaccacctgcttttgtacggctcaggagctggaaatggcttttacatttttaagtagttagaaaagatcaaaagtgtaataatatctcctaacacataaaaattagatgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaagccagaggttctcaaactcagtgtccatcagaaacccccggagggcacgtttaaacatagactatgggccgggcgcagtggctcacgcctgtaattctaacactttgggaggccgagagtttgagaccagagcattgtttaagccaagagtttgagaccagactggacaacatagcaagaccctgtctctacaaaaaataaaaaaaatagctgggtgtgggggtgcacacctgtagtcctggctacatgggaggctgaggcaggaggatcgctcaagcccaggagttggaggctgcaatgcgctatgatagtgtcactgtactcctgcctgggcaacagagaccccgattctagtaaataaataaataaaaacatagatcccaccccagagtttctgatttagtaggtctgaactggggtctgagaatttgcagttcttaaaattgcctagacatggcagatgctgctggcctggggatctcgctttaagaagcactggtctaaggcaaccttgggaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcggggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcataccgcttgttaagtgcagagataggattccaactcagaggcatctggctcaagaacccacgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagagggactcaaaggtccaggcctgctcggtgtggctgcggctcaggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacactcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcatgcccttatattcccagctacttggaaggctgaggcagggaaatcacttgaacccgggaggcagaagttgcagtgagccaagatcatgccactgcactacagcctgggcgacagagcgagactctgtctcaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagaatcacttgaacctgggaggcagaggttgcagtgagccaagatcatgccactgcactccagcctgggggatagagtgagactctgtctcaaaaaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactacaggtatacagcaccacgcctcgctatttttttttttttttttttttgtagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggcatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagctggtcaggtctcgccagaaaagttcacgcaataacaaaccagccgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcagaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcgcctgcaggggcttcctgcctggaaagcctgttcctttgcccttcttctccagaggattcacgtacctcagcacatgttcgacgacaaagtcacagcactgcagggacacctcccctggagaggaacacgatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaataattacaaaaggccaggcgtggtggctcacacctgtactcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtatagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttcaattatttatttatttgtgctttcaaactgttttcttaaaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatttgagaacagagtctgccaacccctcctgatgagagactgacccctcatagccactgcaggctggaagccataagcttaaaccacttccataccatgaaagcaaaatgtatggttggcaaaaagcaaaaaaaaaaaaaaaaaacaaaaactggttactggcgagtgcagaaccacagtctgggtcgatgacaaattatccagcatgaatcttggtgtgacttaggcccttcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaactattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacgtaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccatttcggctcactgcaacctccacctcccgggtccaagagattctcctgcctcagcctcctgagtagctgggactacaggcatgcaccaccaccacacctggctaatttttatatttttagtagagacggggtttcaccatgttagcaaggctggtctcgaactcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttttgagacggagtttcactcttattgcccaggctggagtgtgatagcacgagctcggctcactgcaacctctgcctcccgggttcaagcgattctcctgcctcaccctcccaagtagctgggattacaggcatgcgccaccatgcgtggctaattttatatttttagtagaaacagggtttctccgtgttggtcaggctggtctggaactcctgacttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaaagtcagtgtgatgaaaacatgttctagataaaacagaaatgagactgggcatggtggctcatgcctggaatcccagcgccttgggaggccaaggaaggagaatcacttgaggccaggagtttgtgaccagcctgggcaacatagtgagaccgcagatctactaaaaatttaaaaattagctgggcatggtggtgcgtgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaatacaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaaagcgatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagccttttttttttctttttttgagactcttgctctgtcgcccaggttggaatgcagtggcaaaatcttggctcactgcaatcttcgcctctcaggttcaagtgactctccttcctcagcctccctagtagctgggattacaggcgtgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaacacctgggctcctctcaggctcatgcccttcccaggggtctgggaagccctgacctgcagcctgtcacctttgtttaccccccagcctccaggatattatgtgtgcaccggcgtgggatcctggaactggcaggaattgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggaggatcactggagcccaggagtttgaaacgagcctaggcaacagagtgagaccctgtctctatattaaacacacacacacacgcgcgtgcacacacacacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagctgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatgtttccatgacttccactcatttacccccaaggctgttcttaaagacgggcatgacagttatgcccattttacagatggggccctgaggctcacaagggcacgccactcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgctctgtcatcccggctggagcgcagtggtgcgatgtcagctcactgcaaattctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctgacatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcatgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctatgattaaaaacctcaggtccctcaggcaatcataccagatattgaaacaaagcaataacataaggactgcagtattcattttatttttatattatttatttattcttcattagtttcttgagattatcatccgctgagggtggaaggggagtgagcagacacactcgggaggtgtcttgagattatcatccgctgagggtggagctgagggtggaaggggagtgagcagacactcggcaggtgtcttgagattatcatccgctgagggtagagctgagggtggaaggggagtgagcagacactcgggaggtgtcttgagattatcatccgctgagggtggaaggggatagagcagacgctcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacaactggggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacctaaagaatacttttgtccatggaaaaatgaggtgggaattctaaacaaagcaagttttaaaactgtgtttcacttcaagtgtagaagtcccatcgcgtgtaatcataggactcggcagcttttgaaggtacagaggccacacaagaaccagcttagctgagcatcatttaaggccttcatttggaattgtccctgtgggtaataagttacattcactcttcactaatttacagtcagggcccatttgctattacaaatatggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcacctgtaatcccagctactcgggaggctgaggcaggggaatcatttgaacctgggaggcagaggttgcaatgagccaagatcacgtcattgcactccagcctgggtgacacagcgagactccatctcagaaaaacaaaaacaaaaacaaaaacaaaaaaaactgtacagtctgatccaaactgttgctgtattgattcctcctcttgcttactgcctgctgacttctgagatgatagcttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaatggacacctcccattgagggataaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcaaaagctcattttagttcagtgtgaaaaaccagacctcaccaattcatcacaactaactccatcggaagcagaggattgctcctcatctgactcctcctgtgtgagactgattctcagtcagaggctgatgccggaactgagaccatcagccatagagagatccttccagaatatggtgtcattaaccctgcagttcactactgcactttgccatgattcaggactggaactcttgtcatcgactttaaagatcctgaaaaggcaatctgaatgctgggcgcatctattgaattagaaatgatgggaatggctcctaagtcagggtgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcgtgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccctggcctttgtagggactgagcctgcacagacgacctcaattgcagcctgtatggaggacccctgaccatcccccagaagtagactcccatctcttctgcagcaagataacatgctactaggtctcagttcattgctaaatattttttaaaaagtatctcacatttaacaaaaaaagatcagtcatatggcagcaaaatacaatgtaatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaattggccgaatgtggtggcacacacctgtaatccaagctactcgggaagccgaggcagaattgcttcaaactgggaggcagaggttgcagtgagccaagattgcaccatagcactccagcctgggcgacagagcgagactctatctcaaaattaaaaaaaaaaaaaaaagcctgggtgtggtggctcatgcctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccgtctcaggaaaaaaaaaaaaagagagagagaaaggaaaaccaatgccagtactagcaactcctcttcccctgaaaaaatgacaaacaagattgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctaggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccaagctactcgggaggctgaggcagagaaccgtttgaagctgggaggtggaggttgcagtgagccgagatcacaccactgcactccagcctgagtgacagaatgagactctgtcacacacacacacacacacacacacacaaacacacaagaatgacatgaggctggcatggtggctcactcctgtaatcccagtactttgggaggccgaggcaggcggaacacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaataggccaggtgcggtagctcacgcctgtaatcccagcactttgggaggccgaggcgggtgaatcacggtccagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaatgacatgaatatacttcacacaactgaactgtacacttcaacatggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaatgcaaaacattctcactaatgattgaattcccaccaagatttccatattatcacagtatgcttttaatcttcgaagatattaaatatttgttctcatcatagctaaaatgcaacgcaaatcccatctgagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatgacacccatgatgtccctgcttaggaggtaatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtcgtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaaagcttcctccaatttataccaaaaattctctgttcaggactaagtggcatagagaatgttaaatgtgcctagatatcttcataactcatatattttctgttttctacatatcttgaaaggcagtgccaaatgacgtgtaattatctaggcagtaaaactgaaacatacttcctcttcccttgaatatcaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatacggatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaattttttttttttttttgagacagagttctgctccactcagtcgcccaggctggagtgcagtggtgcaatctcggctcactgcaacctccagctcctgggctcaagccattctcctgcctcagcctcccgagcagctgagattaccggtctctgccaccatgcctgactaatttttgtatttttagtagagatgaggtttcaccatgttggccagtctggccttgaactcctgacaggcgatctgcctgcctcggcctcccaaagtgctgggattacaggtgtgagccaccgtgcccagccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagtgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctgggaatacaggtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaatacaatgaagagattatttcattcacaaataagtatcgaattttagttcttaaaaagtaacaaggtgggccgggcgtggtggctcacgcctgcaatcccagcactttgggaagccgaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacaaagacttcccctgagtaagttcagacagcttgtgataacatttctacatcaattcctcaggatttaactatatattcttgaaaacatctcaattttaaatgtttctttcaagatggtgaattaaacagagatagcccttcaacaggttgaactcagcatatgctgagtctgaaatggaaatgatggagttagagaagcatacaacaatggtaatgatttcagaaatacggtgttgagcagaataaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatagaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcggatcacgaggtcaagacatggagactatcctggcgaacatggtgaaacccagtctctactaaaaatacaaaaattagccaggcgtggtggcctactaaaaatacaaaaattagccaggcgtggtggtctactaaaaatacaaaaattagccaggcattgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaaaaagtcatcaaaccagatgacacaaatcaaatgacatttcactttgttttggtccgttttgtttgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccaacgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggctccctgaggcagccaggacagaggtggaggtggcttagggcagggcggagggaaggggacggggaccggggccggatctgagttggggagggggaggggagggggaggggaaggggaaggggaggggaaggggagaagtaagggaagggaaaggaggagaagggggctgttggggaggaggaggaggagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagtgcccgcatcatcccaatgacccctcccccatctcagtcccccacgctcctcccaaggccaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacaaccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgcgtgatctcaaatcacccctaacccacctagacattttaacatccgaaaccgagtgatgatgtccttatctatattatcttactgcccgtgtgtgtggactttaaattctgaacccaaatgagggggagaaaaccaagctgactttcatgactggcctctcagggatgtccaaggaatctgtgcatttcaagaaacaaagctcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaagcactgctttaaatccctttaccatttactatgacataaggttattgtaaacaggaaatattctattgatgctacaaatggaaagccaatgcctttaccataaatagaaaaacaaccctaagaagcaagcaaaacaaaagaaaacaggggctgggtgtggtggctcacacctgtaatcccaccactttgggaggccgaggtgggcggatcacaaggtcaggagttccagaccagcctggccaatatggtgaaaccctgtctctaataaaatacaaaaattagccgggtgtggtggtgggcacctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggggttgacacgagcctggccaatatggtgaaaccccatctctactaagaatacaaaaattagctgggcatggtggcgcatacctgtagtcccagctactcagaggctgaggcagaggaattgcttgaacccgggagacggaggttgcagtgagccgagattgtgccattgcactccagcctgggggacagagtgaaactctgtctcaaaaaaaaataaaaaatatatatatatgtgtgtgtgtgtgtctgtgtgtgtgtgtgtgtgtgtgtgtgtatctctataaatctcaaaaataaaagatcatttttgagattatcattttaaaagacaagataatgttcaacttaatgaataatttaattattactactggactttttgtagactgcacagagcattcaaaacaaatgaaggagaataaaaaatatgtattacatgttgtaaaataaatgtgatgtggttaattcttttattcaaaattatagaacatatatatgtactgtagaatgtatttcttattatgagtcatgttaaaaagtagtttagaagctgttgatttgaatttccttttcaaattttgcaggataatttttttttttttttgacagagtctcgctctgtcgtacagtctggagtgcaatggcgtgatctcggcccactaaaacctccacctcctgaatttcagcaattctcctgtctcagcctcctgagtagctggaactacaggctgacaccaccatgcccggctaatttttgtatttttagtagggacgaggttttgccatattggtcaggctggtctcgaagtcctggcctctggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgagactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaaccgtggggtcaggacaatagagagcttcaccatttgcagaatgagaacaggggctcatgatgagtgccaacctattagacaattttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttcggtcataattagtgggatccatttcactattattggatatacagttctgtgcctgaaacctacaaaaaaagaaaatgttaagtctaaaaagcattagtgatttctcatttttacattactaattataaccctgtttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataacgagaatccttagctcattcggttgtggtgaggggtgaatgatttggcacacaggaggggcttgttaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggcttctgctgcatctgccttctcagtgttcacctaaggacttttgtattttcctcctcacatccccacagaaggggttcaggctgccgaacacagctgggtgatgccagggcagtggccacctgtgccagccctgtgaggtagctggaggatcattgctccttccttctcaggctctgggcagatgccagggctggggtgacccatgccctcaagtttcttgctttggagggccacattttcccttggcaaagagggtaaaggtcacaggatgccggagagctgtgacttctctgtgccctgggcccaaactatgaagacctgacacactatgctaaaagtccaaggctgggtgctccccagagcttcttgcctcaccacttctgctgagggaggaatgaatactatgtcctcccagagctttgggagcttgtagcaagcagcctccccagcgcaaaatctcttggaaacctctaactgtgtcggaaacattagtgcaaatgttgcatcctatttcccatatgtccgcatgttttaggaaaaaaccctcaatttcctaaatatgcaagaaaaattggtattgtaggacaatgtgactttttaaaaaatgttatttaaacatcttccccacctccttttctgccctccaagactgccaaatacttgttgaacaaatattattaaatgcctactacgtgccagccatgattcatggtcttggggacacagcagagaacgaactgacaggattcctctcttatgtaactcacattcttatatgataatgataagggttaacattaattaagctgtcactacgtgttagtcacggtgcagtcattcccacacattattacacttaaacctgctagcaagcttgcaaggtagttagttgtttttcctttaaaaactgagtctcagaatgatgaagcactttgtccaatgtcacacagctagtaagtgtggagaccttgcatccaatcaatgcccgtctcattctaaacaccacgttatgtgttctccagcccatggagaataattttaacacagtcaatgaaatttctacacaacaatgttcttgtctcaagtccaagaaagccataatactggctttctggtgagtaaagatgccattctcatgtgtaatcaggtggcaaatggagatatgaccaaagtaaccctttgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaatgaacaccctttttaatagtgacctgtgattctgttttgatcaagtgttttcaaacttgacatctttgatgggtttctccagtgtcaaaatcctaaatcaggtctttttggcttaaaattaactttgggatttttccactgcgtcccttcgggagtctgaagaatgcatctctcatcttgtagagatattaagtgattcgatttatttggtagattatatgggcgggcattgtcaaatgtggtgatactgcatgggagggcactgtcaagtgaggtgacattagatctcatctcagttatatttatgggtatgttgttgatatacatgttccaaaaattacatacatttatacaaatttaatatgttatgatttgtaattttgatagttatactaaatatttgttaaagttatatttgtataaacatgttatgaatggctgggcaccgtcactcatgcctgtaatcccagcactttcggagacaaaggcaggtggatcacctgaggttgggagttcgagaccagcctgactaatagggtgaaaccctgtctccactaaaaatacaaaaattcgccatgcctggtggcacatgcctgtagtctcagctactcgggaggctgagacaggaaaattgcttgaacacaggaggcggaggatgcagtgagtcgagatcatgccactgcactcccacctgggcaacagaggtagaatctatctaaaaaaaaagttattaattatttctgaagattatatgaaatttataaaagtctggtggtcctgatgtgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcttgtttttgagacacagtctggctctgtcgcttaagctggagtgcaatggtgggatcttggctcactgcaagctctgcctcctgggttcacgccattctcctgcctcagcctcccaagtagctgggactacaggtgcctgccaccacgcccagctaattttttgtatttttagtagagacggggtttcactgtgttagccaggatggtctcaatctcctgacctcgtgctctgcccgcctcggcctcccaaagtgctgggattacagatgtgagccaccgcgcccagcttaatttttgcatttttagtacagaggaggtttcaccatgttggccaggatggtctcgatctactgaccttgtaatctgcctgcctcggcctcccaaagtgctgggattacaggcatgagccactgcaactgaatttttttttgtttgtttgtttgagacagagactcactctgtcacccaggctggagtgcagtggcatgattttggctcactgcaacctccacctcctgagttcaaacaattatcctgcctcgtccttcggagtacctgggattacaggtgagtgccaccgtgcctggctcatttttgtatttttactagagacagcgtttcatcatgttggccaggctggtctcaaatcctggcctcaactgatccactctcattggccttccaaggtgctgggattataggcatgagacaccacacctggctcagtaagtacattttttattatcaaaaaagagtagtgtatgattggcttattctgtgtagaatgtattttatcgatggcttctatttttataatttctgagttaagtaatttttaatgaatgctttttagtttggggcagattcagttgactaaagcacctcatttcccagatacatgaaataaaatatttggcttcttttccaatttcacactgatgttattttgtgaaaatcagtgctttaagataaatctttatactttaaggtaaacatgagaaacttgatctaatatttaatatttattcagttctacactttattaacttctacaccagcagatttaaaaattatgtaactatctcaagaagtttcacttgggtgtaacggttcacgcttgtaatcccagcactttgggaggctgaggtgggaggattgcttaagacaaggagtttgagaccagcttgggcaatacagcaagatcccatctctattttaaagaaaagtttcactttgggaggccaaggcaggcggatcacaaggtcaggagatcgagaccatcctggctaacatggcaaaaccccatctctactaaaaatacaaaaaattagccaggcgtggtggtgggcacctgtagttccagctactcgggaggctgaggaagaagaatagcgtgaacccaggaggcagagtttgcagtgagctgagattgtgccactgcactccagcctgggcgacagagcgagactccgtctcaaaaaaaaaaaaaaaaagtttcagcaaattccacctaagaattccaccagagttctgttgtctccaatgtcatgttccacagatttcaagttgtgaagccctgaactgttaatttatcttgagaatgtacatttaagcttaatttaagactatatacctaaaaattgagcatataatttgtataatttgtttatgtaagtttttgtaagtcataagtatgtagtttccaagtatataatttatctgaatgtaataggcattaatatattttacattattgggaccataatacagaaatttctaaatggtttgtaaaataacttgttatttgcaatgttgtaaaagtagttaatacaatggaaaaactcataataagaagatacattttaacatcaagaagtttacccaaggtaattatgaatactacctggcaaactttacagaagctgtggtatcacttttatgatagaagaatagtgtttgcattttgtgtaaaagtacttggggctgggagtagtggctcatgtctataatcccagtgctttgggaggtgaaggcaggtggatcatctgagcccaggagtttgagaccagcctaggcaacatggcaagagcctgtctctccaaaacctatgaaaattagccaagcatggtggtgtgagcctgtagtcccagctacttgggagactcatgcaggaggatctcttgagcccaagaggcagaagatgaataaataaatggatgccactgaatgagatgaggtctctcttgaaggagagagaaaaagagatttaaatagtaacaattataataaggctgggcgcggtggctcacgcttgtaatcccagaactttgggaggccaaggcaggaggatcggttgaggtcacgagtttaagaccagcatggccaacacggtgaaacaatgtctctattaaaaatagaaaattagccagacatggtagtgcgttgcctgtggtctcagctactcaggtggctgagacaggagaatcgcttgaacctgggaggaataggttgtagtgagccgataaatataaaaagtattagagtcctaacagaggaaagtttccactgatcaccttttagctttgaacaatgcagaagcatttgcccagtttacttgtaattaaaaatcatgcatcattcacaatttatcagtcttttttgtttgtacaaaaactaatataagttattctcttttgtctgtattgtgactggtttggtgagagggaattaggccactcgagagtttgtgtgtgtttaaaattttctggccaggcacggtggctcatgcctgtaatcccagcacattcggaggctgaggcaggggtatcacctgaggtcaggagttctagaccagcctgaccaacatggagaaacccccatctctactaaaaatacaaaattagctgggcgtggtggtacgtgcctgtaatcccagctactcgggaggctgaggcaggagaattgcttgaacctgggaggcggaggttgtggtgagttgagatcacgccattgcactccagcctgggcaataagagtgaaactctgtctcaaataaataaataaataaatacataaactatcacagcataaagtaggagggatatttcattactgtctagttaaactggttaatgcggaaaggaagtctggaaattccagttttaaagtaaaattttggacattgtaggattgattatttggcatagctgtgatgtttgttgctgcattatggttttgttggcagggcagcctttaaggacctgtatattttcttctagactctatatattccccgtcagtattagttgcatggtcaaactggcaaattttaccataggtataaataatagagaatgtggaagaatagtgaatagtgtcagagatagttaaaggtccatacagaagtagagaaggtaataagtaatagtggcttggactaaatatttgttgaataaattttttaaaaaacagcctacctaaaatttgtgttgaagatatgaatgaatgaagtttccgcacccttatgtggagccctgataagtaagcaaaaataaggaagggtccccaggttggggagagccccaagttgaggagaataatgaacaattattgtatgaacaattgttagagacagctaatcacaaacaacctgtgggtacaatgacctcattccacatgtagcacccttaagcatgaccctgtaaaactttcctccagcccttgcctctttgcaggtagctccttctctgctgagctgcccactgcaacatattttcataatttctctaataaatctgcctttctttacctacaactatcttggtaaatagctttaccacctgcaaaactgaccctagttagttgctacccgatatggtttggctgcgcccccacccaaatttcatcttgaattgtagctcccatcatccccatgtgtcgtgggagggacctggtaggaggtaatggaatcatgggggcaggtttttcccatactgttctcgtgatagggaatacatctcactaaatctggtggttttataaagggcagtttccctgcacatgctctcttacctgctgccatgtaagacgtacctttgctccttctttgccttccaccatgattctgaggcctccccagccttgtggaactgtgagtacattaaacctctttttctttataaattacccagtctcaagtatttcttcatagcagtatgaaaagtaactaatacactacccgagacaccttaggagatttgtaacagctgtaatgccaggtccaccatatttttagcataaagcaaatgtttacccatgatatgactgcacaggctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggtaacatggaaaaacacagtctctacaaaaaatacaaaaattagctgagcgtggtggcacacacctgtagtcccagcaccttgggaggctgaggcaggagtatctcttgaacccaggaggtggaggccgcagtgagcagtgatcatgtcagaggcatgtgaaccagagcaactccatcttaaataggagctgggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagtgacaagagtgacctcccgtcatcctcactgctacactcctaccagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcctggctgctctgtctgtggagtagccattcttttattcctttactttcttttttttttttttttttgagatggagtctccctctgtcacccaggctggaatgcagtggcgtgatctcggctcactgcaagcttcacctcccgggttcacgccattctcctgcctcagcctccagagtagctgggactacaggcgcccgccaccacacctggctaatctttttgtatttttagtagagacggggtttcactgtgttaacaaggatggtcttgatctcctgacctcgtgatccacctgtctcagcctcccaaagtgctggggttacaggcgtgagccaccgtgcccctcctcctttacttttttaataaacttgctttcacttcacactgcaggatcaccctgaattctttcttgcacaagatccaagaaccttctcttggggtctggattgggacccctttcctgtaactatcatgccactgcactccagcctgggcaacagagcaaggccctgtctcaaaacaaaaaaaactaatatgacttaatacattcattttggagggcaagtctctcaaaatgggcctttcactgggggaaaatggtaaaaatactccctggtaattcaagaattgcagactcctgagatgctgctcatattagctgaacacttaccaatacttcacttttttccatatatactcaaggaacaagtgctatttaaagtgtttcactctgctgtgctaggtgcaagactataaagaggtgtgaggatcaacacttttatgaaaaccaacgtcattctgaatgtagtttcagatgctagtgcaaaggaagttcttggtatacggaaaaagtattcaacaataaattaggcatggttgcttccattttctgcctcacacacttttttttcgtggttaaagtgataaaacgtctatgatattttagattggcagttgcaaactagtggtcctcagcgggttttttatgacacctacaaggtttgaagactttgatttcatattaaaaatctgggtttcagtctgggtgtggtgctgcacttctgtaatcccagcactttgggaggctaaggtgggtggatcacctgaggtcaggagttcgagaccagcctggccaacatgatgaaactctgtctctactaaaaatacaaaaattagccaggcatggtggcatgtgcctgtaatcccagctactcaggaggctgaggcaggagaattgcttgaaccagggaggtggaggttgcagtgagccaagatcgcaccactgcactcaagcttaggcaatagagcaagactccatctcaaaaaatgaataaataaataaataaaatctgggtttcaggccagctgtggtggtgcactcctgcaatcccagcactttgggaggctgagatgggcagacagcttgaggtcaggaattccagactagcctgggcaacatggcgaaaccccatgtctacaaataatacaaaaaaattagctgggtgtagtggagtgtgcctgtaatctcagcaacttgggaggctgaagtgagaggattgcttgagcctgggaggttgaggttacagtgagccaagatcgcactcctacactccaacctgggcaacagagtcagaactactcttaaaaaaaaaaaaaaaaaaaaaaaaaaaaaaattctgggtttctggcatctcaaaaaaaaaaaaaaaaaggaaaggtcagggcagctacagtcctctattaagcaatgtgccacagcaggggtccctaattcctgggccatggacctgtactggtctgtggcctgttaggaactgggccacagagcaggaggtgaatggtgggtaacaactgaagcttcgtctgtatttctggccgctccccattgtttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattagcatcctgtgccccatcccttgccgcctgtggaaaaattgtcttccgcaaagccagtccctggtgccaaaaatgttggggactgctgtgctttagaatctgcctggaatctgcagcctctattatatagttccctatagactttgcttcctaccatcttacattctgccttataggcatttgtgtttgcaactcttgcttttgtcagtatgctacgctggtgacattgaccaaattgaccacacattaattataagcttagttggtgatgacctcaatggaataacatgacataagtattgtgacactacttcttgcatgtatctgcaggtggaattgtaaacctggtggtccgagatggtctaattcgatcttcctatgtatctccttatattaatagtggtaacatttgtggtggtgattcagcgtttcaatgcctcttctcatggcaacaacaaacgttttccgtctgaatcaacattaacctagatgttactgcggatcagaattagactctacattttcaaccacagaaatattgggcagtaaacatttttcttaatattgattgcctacataggttgtgtaattagcatatgtttatagttctatgatttgtgcatggctgctgcagagctggagggggtaaagcaacagtgttttctcagttgtgcgagcagcattacattataatgaataggtaatattaaactgggctgataagagttgcaaaagactactttaatgttcatatggaaccaaaaaagagcccgcattgccaagacaatcctaagcccaaagaacaaagctggaggcatcatgctacctgacttcaaactatactacaaggctacagtaaccaaaacagcatggtactggtaccaaaacagacatatagaccaatggaacagaacagagccctcagaaataataccacacatctacaactatctgatctttgacaaacctgacaaaaacaagaaatggggaaaggattccctatttaatagatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtgaacaggcaacatacagaatgggagaaaactttcataatctacccatctgacaaagggctaatatccagaatctacaaagaacttaaacaaatttacaagaaaaaatcaaacaaccccatcaaaaagtgggcaaaggatatgaacagacacttctcaaaagaagacatttatgcagccaacagacacgtgaaaaaaatgctcatcatcactggccatcagagaaatgcaaatcaaaaccacaatgagataccatctcatgccagttagaatggcaatcattaaaaagtcaggaaacaacaggtgctggagaggatgtggagaaataggaacacttttacactgttgatgggactgtaaactagttcaaccattgtggaagacagtgtggcgattcctcaaggatctagaactagaaataccatttgacccagccatcctattgctgggtatatacccaaaggattataaatcatgccgctataaagacacatgcacacatatgtttattgcggcactattcacaatagcaaagacttggaaccaacccaaatgtccatcaatgatagactggattaagaaaacgtggcaattatacaccatggaatactacgcagccataaaaacggatgagttcatgtcctttgtaggaacatggatgaagctggaaaccatcattctgagcaaactatcatcaggacagaaaatcaaacaccgcatgttctcactcataggtgggaattgaacaaagagaacacctggacacagggcggggaacatcacaccctggggcctgtcatggggtgggggaagcggggagggatagcattaggagatatacctgatgtaaatgacgagttaatgggtgcagcacaccaacatggcacatgtatacatatgtaacaaacctgcacgttgtgcacatgtaccctagaacttaaagtgtaataaaaataaataaataaatagggctgatgaatcatattacagtaatccaatatttcccttgtaaagtccctgaggtttacagaaggaaatcttttctaataacaaaaagagtgaggcatgtgctttggtctttatttcctagttatacgatcctgggtaaggagctcaacttttctctgccaaaattaaatgaggattaaatgagatcatatatgtgaagttgtgaaagacagtacctggcacatagcaggatcaatcaatgttagtatctctaaaatagagattgagtctgaagatccacaaagtggtagaaccgatcttaagattcccaaataatagaattgtgctttatttgcctaagtagtatggtattacttattgtatgcccaggggatcttttttttttaaataatatttatttatttattttgagacagagtctcactctgtcccccaagctggagtgcagtggcaccattttggctcactgcaacctctacctacccagttcaagcaattctcctgcctcagcctccggagtagctgggattacaggtgcacaccaccatgcccggctgatttttgtatatttagtagagacagggttttgccatgttggccagattggtcttaaactcctgacctcaggtgatccagctccctcagcctgccacagtgctgggattacaggtgtaagccaccgcacccagacctaatgttttattttttggtagagatgaggtcttactatgtggcccaggctggtcttgaattcctggacctaagtgatcctcccaccttgacctcccaaattgttgggattacaggcatgagccaccgcgcccagttcccttcttaaatagttttaagggggagaagaaagaaaaagactgattttcttcccttccactaccaaaacaggcaaaacacaccagaacactttgcttagcatttcttttcttttctttttttgagaaagagtctccctctgtcagccagggtggagtgcagtggggcgatcttggctcacttcaagctccacctcctgggttcaggccattctcctgcctcagcctcccgagtagctgggactacaggtgcccgccaccacgcccggctaattttttgtatttttagtagagacgggatttcaccgtgttagccaggatggtctggatctcctgacctcgtgatccgcccgccttggcctcccaaagtgctggtattacaggcgtgagccaccgtgcctggccgtcccatcattttttaagataaattcacataccataaaacttaccattttattttctctctcttttctctttcttcctttctttctttcttttttttttttttttttgcaggctggagtgcagtggccctatcgtggctcactgcaaccttgaattcctgggctcaagagatcctcccacctcagcctcccgagtagcagtagctgagactatcagtgcgcaccaccaagcctgagtaattacaatacttttttctttttccttttcttgattttccgtagagatggggtcttcctattttgtccaggctgatctggaactcctgccctcaaaggatcctcctgtctaattctcccaaagtgctgggattacaggcatgtgccaccgcgcctggccaaatgcaccccctttttttaagtgtacaattcaatggtttttaatagattcacaaagtcatggaaccatcacacctatctaatttcaaaatgttttcatcactccaaaaaataaccccatatgggaggccgaggcgggcaggtcactcgagaccagcctggccaacatattgaaaccccgtctccactaaagatacaaaaattagtcgggcgtgatggcgcacgcgtgtagtcccagctgctcgggaggctgaggcaggagaatcgcttgaacccgggaggcggaggttgcagtgagcccagatcgccccactgcactccagcctgggcgacagagcgagactccgtctcaaaaatatctaattaattaataaaaataaaataaataaataaataaccccatgccttctgcctctgtggctttgcctgttctcggtattttgtgtcaatggacccatgcatgggggtgggccgggcacctttcaaacgttcagcccccaggacggcccgtggcctccggattggacggcgcgagctgggtgtgtgtgggtcgctcaatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggggctctgagaccggagctgcttcagaggcctgaagggccagggcaaaggctagaggctggggtgtttgattgcgaaaatttgcaggaggcactggctggggagccgagaaattggggagccagaggtccaccaggtcaggaatttagaggactagggtcggggctcagactctggggttgggtgtagaccaaggctggaggtaggcagggctgcggaggtctttgccccctgaaaaaggcccacgggaaaataaaggagatcccagttcaaggccgtagcagctgcaatgaccgtgaaccagtcgtgggacagggaaggaaccgacctgctgttcagaaaatccacgcctggggccccggggccaacacaggaacaaaatgcaaggggatcagtgaccctgaggggcagagcaggtggaatctgaggttgggcctggatcttcagcaaattcatgcccaggggcctagtcctggtttggtaacaagattttcccctggggtctcacggaaaacatcaagggaccttggatccttgccatggaggactatatacctgtgagggttcagggaaccctctccttagaaaatccgacccgggcctggggtgtgggggacaggggcttgactgtggaaaccttctctactgcatacaataagaacaatggaaatggtacctgaaaaataccggggttcattcccttaacgagtcacaaaggactccaccaagaggcggattttgatcaatgggagttttacttggcacaagaaaggaagacactgggcgtattctcccaagtagtgtgtcccccagagaaagagacaggagggttttataaggtgatggagaaaggagagggtgcatgactgcatgtagagtaggggtcccagtgagtcatgatgctagcacataggctgcataggttgcataggttatagtcgtgaagctatagcttctcccggggtgaagactttagcatggtaatgaggagagttaacttgggttcatctacaagtaacctggggtcacttaggagctgatttaaacaaacagggtgacctcattccgcccagggttggggaagaacaggttgaggtcaggaggctgtaaaacaggctgatcgctcaagttggttaaattcttgtcatctttggagatcccccgtctgctcacaggaggggccctgtggcctctagcatcattgcgatttctagagccttgaaggggatggggtgggtaactggggagaaaatctctacgggtctcaagcctgaccttgggattggggatcacagatctccccccaaatgggagggaacttctcctaagggctgttggtgctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggccaactacatggctgacggggtcagtgggtcaggagagcaggcagcctgagagctagggcctcctgttttatcagaaggtctgtgcctgtgcccggtgtgtgatttgcagactagatttgcaaacagcttcctagcacctgttacaggaacctggtacactggtgaaggggtaggggaccagaatgctatttaatcctcaaacaactagtgagattgttctctttttcttcttttttttttgagacagagtctcgctttattgcccagcctggagtgtgcagtggcccagtctcagctcactgaaacctgcatctccaggttcaagcaattctcctgcctcagcctaccaagtagctgggattacagatgcacaccaccatgcccacctaatttttgcatttttaatggagatggggtttcaccatgttggccaggctggtctcgaactcctgacctcaagtgatctgcccatttggcctcccaaagtgctgggattacaggcgtgagccctcacacttgagattgttcttaatactctcatattacaaatgaggaaactgagtctcaaaggggttctgtgactcacccaaagacaacacaatccaggcacttgatgctctcatggtgggaagtttgacagtttgcctgaaactgaaagatgctgagttactaacaagacttgaacctaagtccaggccaagctctctgatacagattcctggccagattgcagctttgctttggtcttcagtttttcttttctttctttctttttttttttttttgaaacggagtcttgctcttgttgcccaggctggagtgcaatgacacaatctcagctcactgcaacctcagcctcccaggttcaagcgattctcctgcctctcctgcccctcctgagtagctgggattacaggtgcccgccaccacgcctggctaatttttgtgtttttagtagagacggggtttcgccaagttggccaggctggtctcgaactcctgacctcaagtgacttgcccacctcggtctcccaaagtgctgggattacaggtgtgagccacctcacctggccggttttcagtttttctggttcagtttcccttacctcacatttcaatgaaaggggaagtggaaggggatagagtggaggtttgcgtaaggctttacatggaaattgcaggaatcaattgatctttgtgctggggctaccttggggaaccagagtcgtaacagattaacaactctggcttgggaatcagacacctgggttgaactctgtccgctattaacctctctaagctcttttcctcctttgtaactctacccaccttagcgaattgtaaggaggggcacatgaaatgaggcacgtaaactacatagcatttaattaatgctgggtaagtggaacacagtattaccaatattttgctgggtcatgtaagaatcgtctgtaattaactaataaagctcttatattccctccctcctaatcagggattggaaagaatttttaaagtactctcagttttacaaccttcctaaaataggagagctttgccttgctacctgaatttattgttacttttttccttttctttttctgagacagggtctcactctattccccaggctgaagtgcagtgatgtgatcacagctcattgcagcctcgacctcctgggctcaagcgatcctcccacctctgcctctggagtagctgggactacaggcacgcacccctatacctggctggtttttaaatagttttgtagagacaaggtcttgatatattgcccaggctgtgaatttctcttcagggatattgaagatcaaagtgtttttaggaagggtgaattggtgttccactttcaaattttgaatagggtaatactgatggaaaatttgtagtcgccagagtatttgggtccactggcctttttttatttttatttttttgagatagagtcttgctctgtcacccagtcaggagcacagtggtgcagtctcggctcacctcaacctccaaatcctgggttgtgtagtggtacaatcttggctcaccgcaacctccacttcctgggttcaagcgatccttctgcctcagcctctcaagaacctggaattacaggcatatgccaccatgcctggctaattttgtatttttagtagagacggggtttctccatgttggtcaggctggtcttgaactcccaacctcaggtgatctgccagatcagcctcccaaagtgctgggattacaggcatgagccacgcgcccagcccactagcttttttaaaaagacagaaattaaaatttcaaaatgttcaaatgttcaacatttcacaaaatgtttggaaggtagagaaagtaaccaatagacccactattgtaacctgattgtttttgtgaattgttagtttttgaaaaaataatcgttctgctataatttttatactctgctattctcacttcgtatttatcattcctttaaaatttatctagttttagagtggagattatgttttcttttttttttttttttttgtttgagacagggtcttgctgtgttgcccaggctggagtgcagtggcatgatcacagctcactgcagcctccacctcccaggctcaagcgatcctcccacctcagcctcctgagtagctatgactacaggcacgctactacacctggctaatttttgtattttttgtagagatgaggttttgccctgttgcccaggctggtctcttaactcctggactcaagcaatctgcctgcctcggcctcccgttacaggcttgagccacggcgcctgtctatgttctcttttcactgttgggtcagagggtcatattgttggatgatagtgatggttactttgcattttggaatgggaaacttaaacatgaactgttatacggtactctactgaatcttttaaaattttttttgggttttgcaaataggtatgagcattctccaaggaaaggatgacatatttttggacctgaaacagaaattctggaatacctatctggtaagataggcgtttgaaaatgtaatcactatatttttgtgtatatatgtatatatatgtgtataaaaatatatgttttgtgtttatatttataaagattaaaaaatcttttaattgacacatataagtacatattttcatatacatgtgataatttgacacgtgtttaatcacatcaggatttttttgtatgtgtgtgtgtatatatatatatatatatatatatatatttttttttttttttttttttttttaattaaaaaaacctttttcgagacagggtctcattctggcacccaggctggaatgcagtggcatggtcatggctcactgcagcctggacctcctgagctcaagcgatcctcccacctcagcctcctgagtagctgagactacaggcatgtgccaccacacccagctaattatttttaaattttttggtagagacagagtctcactatgtagcacaggctggccttgaactcctgtgctccagtgattctcccacctcaacattaagtacatttttattaaactattcctaaattagagctccagtttggttgacagaagggtccaatattttgacatagaaatcttaaagttattttgatagatgtatgaggagaggttttaagagtatctgtacttctcatgaactggaaagaaataatgtctctgggcccggtgcagtggctcatgcctgtaatcccaacacttgggaggctgaggcaggcggatcacttgacgttaggagtttgaaaccagcctggccaatatggtgaaaccctgtttctactaaaaatacaaaaaatagtcaggcacggtggtgcatgtctgtaatcccagctactcagtaggccgaggcaggagaatcacttgaacctggagacaggttgcagtgagccgagatcgcaccactgcactccagcctgggcaatacagcaagactccatctcaaaaaagagaaaaaagaagaaaagaaaagaaataatatctctgaattttagtccatgttctcagtgatttctgactttattatattaactcttagtaatgatcacaatttactttgtaaattttgcagccaaagggacaacaatttattctgtaaatttgggattctatttgcaaaatagagattatagattgtgagtggcttaatggaatcattcccacattcagagccaatgttttcaggtgagcatcctgcggagtcctggtgaaaagaactttaacatcacaaaggtattgatagagaaggagaaggtttccaagggttattccaaggtttgaagcaaatcagcatttttactgtttgctcggcacaaatatatacagtccagtccaatacatatttattcattgattcagttaatatttattgaacagtgtccttaaggcctggcaaaatcagggatggttttcatctctgccctagagcatgtttgattgcattcatcacaaggaggtaaatctttgggattacagaatgttcgcagactggcctagggcttcacatgttcttccttccctatcaaaagcagtgttgagccacacccagctattacctccacagcttctagcatcatctgttggatggtaccaggcccctgagccagcattacttgatggctagaggcagaggatggagaggtttgaagtcagaggcttcccctgagcctctatactcaggaacagtaactataagtgtgttcagaactcttgtgatttctcttagggcagaaattgaggaccccatggtgacaaccaaatgtgattttcttctggttttgttttttgtttgtgtgttttggtttttttgtttgtttgtttgttttttgagacggagtcttgctccgtagcctaggctggagtgcagtggcactctgcaacctttgcctcccgggttcaagcaattctcaattctcctgcctcagcctcctgagtagctggaattacagacttgcaccaccacatccagctaattttttgtatttttcagtagagatagggtttcaccatgttggccaggttggtcttgaactcctgacctcaggtgatccgcctccctcagcctcccaaagttctgggattacaggcatgaatcaccatacccagccacttcttctgttttactttagaaaaaggaacaagtttttccattatgttgtaaagtctatggagatatgtacatctaacttttttttttttttttttaaagagcaaggaccggaggcagtagctcatgcctgtgatcccaacactttgggaggtggaggcgggtagatcacaaggtcaggagatcgagaccatcctggctaacatggtgaaaccgtgtctccactaaaaatacaacaaattagcagggcatggtggcacaagcctgtagtcccagctacttgggaggctgaggcaggagaatcacttgaacccgggaggcagagactgtagtgagctgagattgcgccactgcactccagcctgggcgacagagcgagactccgtctcaaaaaaaaaaaaaaaaaaaagagcaagaagtaggcagctcacacctgtaatcccagcactttgggaggctaaggcaggaggatcactagagcccaggagtttgagaccagcctgcgcaaccatagtgagaccccatcgctacaaaaataaaataaattagctgggcatagttgcaagtgtctgtggtcccagctgctcgggaggctgagatgggaggattgcaagcctgggaggtcgaggctgcagtaagctgtgattgcaccgctgcacaccagcctgagtgacagagtgagaccatggttcaaaaaaaaaaaaaaagagagcaggaagtagaattgggaaagaagcttcaggcagggatttgtaaatgaacaaaaccacaggaacatttgcatactgtttaaaaaaaaaaactggttacaatgagtgagtctcatctaccctcaggagaagaaagagggcaaaccagtagtctgaagcccagcccatctggagattttttgggaagatttcctttaaagaggcaggatggctcacgcctgtaatcacagcactttggtaggccaaggcaggcggatcatgaggtcaagggatcgagcccatcctcgccaacttgatgaaatcccctctctactaaaaatacaaaaattagcatgagcccaggaggtcgagactgcagtaagctacgattgtgccactgcactccagcctgggtaacacagtgagaccctgtctcaaaataaaaaaataaaataaaataaagatctgaagttatgcacatactgggggacaggtcattccaggggcagaagagctgagtacagttgacaatgcgtaaagcaccatggtatgcctggaggggagaaaccacaggcagtttggtgttcacagagtatttgttgagcaacttggaatgagtttggatcctggagactgttgaacacccagagctgaggatcttgaacttcacagttaggtaatggcagcaaaggaaaccaaagtgggtggttatcgtgaccaagttcacataagaaataaggaagcatatcaggtgtggtggctcacgcctgtaatcctaacactttgggaggctgaagcaggaggatcccttgaagttaggagttcaagaccagcttgggcaacatagcaagaccctgtctgtatttaaaaaaataaacatggtggctcacgcctgtaatctcaccactttgggaggccaaggcgagcagatcatatgaggtcaggagttcgagaccagcctgaccaacatggtgaaaccctgtctctactaaaaatacaaaaaattagccaggtatggtggtgagtgcctgtaatcccagctactcgggaggctgaggcaggagaatcacttgaacccgggagacggagattgtagtgagctgagattgcaccactgcactccagcctgggtgacagagcaagactccatctcaaaacaaacaaacaaacaaaaaagaaatgaggtgagttcagcttgggaaatgttgaatgtcagatgcctttggcctattcagagggagattgccgaagcacagaggagagttcatggcagggtttaattatttttagcgctcacatgtcccagattcggccagtgggagttcccccaagctggttcctgtgtcctgtgcatcacccatcttctttctcctttacttctttcttaagccacttcctttctggcatgacagcgtgttccaggatcatcttgtacttgcacctgccctgccctggccctagaatcagccaattctttgaggcatcctgcttccttttagtgggggaatgatttgagaacaaaatatactactacatgatactacattctgacaagaaaaaaaacacagccataagaaataaagccatggccaggcacagtggctcctgtaatcctaaccctttgggtggcggaggttggaggattgtttggggtcaggaattcaagaccaacctggcccgcatagtgaggcctcgtctgtattaagaaaaaaaaaaaaaagaaagaaggaaagccatgtttggataagtttagtcttctgattatttttgctaaagttttaattttttttttttttttgagacagagtctcgttctgttgcccaggctggagtgcaatggtgcagtctcagctcactgcaacctctgcctcccgaattcaagcgactctcctgcctcagcctcttgagtagctgagattacaggttcctgcaatcacgtcctgctaatttttatttttagtagacacagggtttctacatgttggtcaggctggtctcaaactcacgacttcaggtgatctgcctgccttggcctcccaaagtgcagggattacaggggtatattttatatttaaagcatatttaacaattaagggccaggctcggtgtctcacgcctgtaatcccagcactttgggaggctgaggtgggcagatcacctgagctcgggaatttgagatgcacaacaagagcgaaactccgtctcaaaaaaaataaataaatataaaatatacattatggccgggcatggtggctcacgcctgtaatcccagcacgttgggaggccaaggcgggcagatcacctgaggtcaggagttcgagaccagcctggccaatatcatgaaaccttgtctctactaaaaatacaaaatttagccaggcatggtcgtgtgcacctgtaatcccagctactcggaggctgaggcaggagaatcacttgaacccaggaggtggaggttgcagtgagccaagatcgcaccattgcactccagcctgggcaacaagagcaaaactccatctcaaaaaatatatatatatacatacacatatacgtatatatgtgtatatatacgtatatatgtatatgtatacacacattatatgtaatatctacttttaaatataaacataaatattataaagcttttattgcaattgttcattttagaaacttcagaaaatacaaattagtaaaaagaagaaaataagtctgtaataccacttttaaggactattttgaaaacctctagctgttttttgagataaatttacataccaagacttttttttaaaaaatcataatgatgactttttcataggactgtgtaggataaagcttgtgaaatgtctatctaacatattttgtaatatatgaaaatttcagctaaacttgttctatagcatcacatggtttcaatatattattagaaaatcattccataaacaatggtttggtatatagtttcaacaattcaaggctgggcacagtggctcatgcctgtaatcctaccactttgggaggccgaggcaggcaaatcacctgaggtcaggagttcaagaccagcctggccaacatggtaaaaccctgtctctactaaaaatacaaaaattagccgagcatggtgtcaggcacctgtgatcccagctactcaggaagctgaggcaggagaactgcttgaacctaggaggcagatgttgcagtgagccaagatcttgccactgcactccagactaagcgacagaatgagattccatctcaaacaaaataaataaataaaataattcagcaggatgaggtggctcatgcctataaccccagcactttgggaggctgcagtgggactactgcttttgcctgggagttcaagaccagcctgggcaacatagagataccatgtctcagaaaaaaaaaaattaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattctaggtcaggtatagtggctcacacctgtaatcccagcactttgggatgccgaggtggtggatcacctgaggtcgggagttcgagaccagcctggccaacatggtgaaaacccgtctctactaaaaatacaaaaattagccaggtgaggtggtgtgtgcctgtaatcgcagatactcaggaggcagagacacgacaattgcttgaacccaggaggcagaggttgcggtgagctaagattgcaccactgcactccagtctgggcaacagagtgagaccctgtctcaaaaaataaaaaacaaaataaataaataaaaaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaattttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggaaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaatgactgaaaaagtttcttttaatactttcaacagctgatacataaaaagggaaatctggaatttgaagataaagtatgtgctggagttgaaaggttaggaacacatgaagatctgtgaactgtagctaaccttgtgaatagaaggcagtaattactgagtaacatttttggtatatatcaagtaaaagcttgtcttttcctagttctcttctcctttgttaagtgtatccttctctaactacatctttattcatccttttcttccttcctctttctttgtccacaacccaaccaaacccactgctctctcctctcaccccctgcccgtgccatgaccacttgaacattccaggagggcagaataattgtaataaggctaagggcttattacacttcttacacttaaggactcaacagccttgctttagagaggatggtagcggaggatcctctctggtctctgtgagaagaaaagagaaaggaccatcctacggagaatttatttttatttttatcttttttgagatggagtctcactctgttgctcaagctgcagtgcaatggcatgatcttggctcactgcaacctccgcctcccaggttcaagcgattctcctgcctcagcctcccgagtagctgggactacaggcatgtgccagcatacccagcgaatttttgtatttttagtagagatgggatttcaccatgttgcccagactggtcttgaactcctgacctcaagtgatctgcctatctgtctatgatattttaggttggcagttgcaaactaatggtccacagcgtgctttttatgacacctagaaggtttgaagactttgatttcatagtaaaaatctgggtttcaggctgggtgcggtggtgcatgcctgtaatcctagcactttgggaggctgaggcaggtggatcacctgaggtcaggagttcgagaccagcctggccaacatggtgaaactgtctctactaaaaatacaaaaattagccaggcgtggtggcatgtgcctgtaatcccagctactcgggaggctgaggtgggagaattgcttgaaccagggaggtggaggttgcagtgagccaagattgcgccactgcactcaagccttggcaacagagcgagactccatctcaaaaataaataaataaacaaataaataaatatataaaatctgggtttcaggccaggtgtggtggtgcactcctgcaatcccagcactttgggaggcggagatgggcagacagcttgagcttaggaattccagaccagcctgggcaacatggcaaaacgccatctctacaaataacacaaaaacattagctgggtgtggtagagtgcgcctgtaatcccagctacttgggaggctgaggcgagaggattgcttgaggctgggaggttgagccacgatcacactcacacacttcaacctgggcaacagagccagactgtctcaaaaaagaaaaagaaaagaaaaaagaaaagaaaaaaggaaacgtctgggcacatgcctgctacagtcctctatgaagcaatgtgccgcagcaggggtccctaatccctgggccatggacctgtactggtctgtggcctgttaggaactgggccacagagcaggaggtgaatagtgggtggacaattgaagcttcatctgtatttctggccgctccccattgcttgcattgctgcctgagttctgcctcctcttagatcagcagcatcattagattctcataggagcataaaccctgttgtgaattgcacacacaagggatccaggttgcatattccttatgagaatctaattcctgatgatttgtggtggaacagtttcatcccaagaccattaccatcctgcgctccatcccttgctgcctgtggaaaaattgtcttccacaaagccagtccctggtgccaaaaatgttggggactgctgtgctttagaatgtgccttgaatctgcagcctctattgtatagttccctatagactttgcttcctaccatcttacattctgccttataggcatttgtgtttgcaactcttgtttttgttagtatgctacgctggtgacattgaccaaattgaccacacattaattataagcttagttggtgatgacctcaatggaataacgtgacataagtactgtgacaatacttcttgcatgtatctgctggtagaattgtaaacctggtggtccgagatggtctaattcgatcttcctatgtatctacttatattaatagtggtagcatttgaggtggtgattcagagtttcaatgcctcttctcatggcaacaacaaatgttttccttctgaatcagcattaacctagatgttactgcagatcaaaattagactgtacattttcaaccacagaaatattgggcagtaaacatttttcttaatattgattgcctacataggttatgtaattagcatatgtttatagttttgtgatttatgtgtggctgctactgagccagagggggtaaagcaacagcgttttctcagttgtgtgagcagcattacgttataatgaataggtaatattaaattgggctgatgaatcatattacagtaatccaatatttcacttgtaaagtccctgaggtttacagaaggaaattttttctaataacaagaagagtgaggcatgtgctttggtctttatttcctagttatacgatcctgggtaaggagctcaacctttctctgccaaaattaaatgaggattaaatgagatcatatatgtgaaggtgtgaaggacagtgcctggcacatagtgggatcaatcaatgttagtatctctaaaatagagattgagtctgaaggttcataaagtggtagaacagatcttaagattcccaaatgatagaattgttatttatttgcctaagtagtagtagattacttattgtatgtccaggggatccttttttttttttttaataatttttatttctttaagacagagtctcactctgtcccccaagctgaatgcagtggcaccattttggctcactgcaacctctatctccctggttcaagcaattctcctgcctcagcctcctgagtagctgggattacaggtgtgcaccaccatgcccggataatttttgtagttttagtagaggcaggattttgccacgctggccaggctggtcttaaactcctgacctcaggtgatccagctgcctcagcctcccaaagttctgggattgcaggcatgagccactgggcctggcctttttttttttttttgtgaggcaggatctcactctgttgcccaagctggagtgcagtggcactaccatgcctcactgaagctttgaactcactggctaaaaagattctcccacctcagcctcctgagtagctccatgggtatgcaccaccacaccccattattttattttttgagaaggagtctcactctgtcacccaggctggagtgcagtggcatgttcttgactcactgcaacctccacctcccaggttcaagcaattctcctgcctcagcctcctgagtagctgggattataggcgcatgctatcttgcctggctaatttttttgtatttttgtattttttaactagagacagggcttcaccatgttagccaggatggtctcgatctcctgaccttgtgatctgcccacctcggcctccaaaagtgctgggattacaggtgtgagccaccgtgcccagccctggtattttttttttttttttttgtagagatgaggtcttactatgtggcccaggctggtcttacattcctggactccgaccttgacctcccgaagcgttgggattacaagcatgagccacctcgcccagttcccttcttaaatagttttaagggggagaagaaagaaaaagactgattttcttcccttccactaccaagacaggcaaaacacaccagaacactttgcttagcatttcttttctaaagtgaccaaaatttataatagacacttaaaatgtgtactggaatatatcccaattatatccccagtctataactcagctatatgcagctcctttgtcttattaatgctatgaatcagcaatagtttatgttttcatatcacctgaggccatgcaatcctcttttttggttgttgaaataatttctataactatttcacaatttcaattgccaacattaattcaacagtatttaagctgtctgtcccagacactatgctagcctttggagatttccaaggtgaataaggtgaggacccggctatttgcctacggtctagcagacagacctttttttttaattttttgagactgagtctcgctctgtcacccaggctggagtgcagtggtgcgatctcagcttactgcgagctccgcctccccagttcacgccattctcctgcctcagcctaccgagtagctgggactacaggcgcccaccaccacacctggctaattttttgtatttttagtagagacacggtttcactgtgttggccaggatggtctagatctcctgacctcgtgatccgcccgccttggcctctcaaagtgctgggattacaggcatgagccactgcgcttggccaccttttttattttttatttttatttttttgataggagtctccctctgtctcccagcctagagtgcagtggcacgatcgtggctcactgcaacctctgcctccagggttcaagtgattctcctgcttcagcctcctgagtagctgcaacttacaggtgtgtgtcaccacacccagataatttttgtatttttagtagagacagggtttcgccacgttgtcaggctggtctcgaaatcctgacctcaggtgatctacccgcctcagcctcccaaagtgctgggattacaggcatgagccaccgcacctggccagcagacagacttctaagcaaattacagctaccactttttgtatgctcactaactgtagataagggtctatgccaagccctttacatcatgtggtaattgatatggtgtagttgagtggtttctaccatcgatttccttacctcccccacttcccaacagctcccagttcctttttggggatcttcccagaagatgactttacttggctcaagaggtggagcacatgacagattaagccaatcagggcgtttcatgccccttgctacagggttcagagacaatcatgttatctgcagctgcccaattagagtgaatctcataacctttgatggaaaaccaggacaaaggcatattctctcattgtgtcatagagatgttaatatagatgtaaggcctaggactaccatagccattttttgttaccgtgaaagacatggaggcaagagggtatcactgaaagaatctcagagaaaccctgatgatttcataacctctgatatagcctatgcccaaagcctgctctgggcttttctgttataggagctaggagattccctttatttttcaaaccactgggaattaggttttctgttacttgaaggaaagcatcataaaggatacacaggaccttttttataacacagtagatattattctcattttatttttgtgtgttttgttttgttttgttttttaagacagagtctcgccatctcagctcactgcaacctccacctcctgggttcaagcgattctcgtgcctcagcctcttgagtagctgggactataggagcgcaccgccatgctgagctaatttttgtatttttagtagagacagggttttgtcacgttggccaggctggtctcgaacccctggcctcaatggatccacccaccttggcctcccaaagtgctgggattataagtgtaagccaccacactcagctgattcatttattttcatttttttttgccatacaaaccaacaacttgcaaactcccattataaacatttccagaaatttatggggtacaggtgcaattttgttgcatgcatagatttcatactggagaagtcagagcttttaggctgtccatcacctaaatgacgtgtattgtactgaataagtaacttctcatcatccacccacctcccacaccctaacccttctcaatctccatcatctatcattccacactctacatttctgtgtacacattctttagcttccacttatgagtgagaacatgcaatatttgtctttctgtgtctggctggtttaagataatggcttccagttctgtccatattgctgcaaaggacatggtttcattcttttaatggttgaatagtattctattgcgtatatgtatcacattttctttttttttttttttttttgagacggagtctcgctctgtcgcccaggcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcccacattttctttatccactcatctgaagatggacacttagattgagtccacatctttgctatagtgcattcactctcattgttatagttgagaaaacaaaggtccttgccctttgccactaagccaatacatggcagagtcaggttgatttccaaacccacactcttatgatcatgcttctagtaactccagtgcagtttaagaggtatatcaaagatacagtagtgacagccaggcatagtggcaggcacctgtaatcccagctacttgggagacaggagaatcacttgcaccggggaggtggaggttgcagtgaaccaagatggtgccactgcactccagcctggtcaacgtagcgagactccatctcaaaataaataaacaactaaataaataaaagggatacaatagtgacataaaggaatgatcagctcattgtgtgtgtgtgtgtgtgtctggtggccatggagatattccagggcaccagacatggacaaaagtatgaagtgaagggctcatggtatatgctaaataaatgtttctattttattttcctttgcgcttctgagaaatttgctgtgctagggaatcttagtgggaggttccaaatgtctctaatgggtccttaaaagtaacacaggggactgagagttactttcaaaaagctagtattttaaaacaggttgtgcagatgaattcagacttttgtttgtttgtttgagacagtgtctcattctgttgctcaggctggagtgaggcagtacaattatagttcactgtagtcttgacctgctaggctcaagcaatcctcctacctcagtctctggagtagctgggactacaggcctccacacctgcataatttttttttttttttttttttttttttgtagagacagagtttcaccatatagcccaggctggtcttgaactcctggcctcaggcagtcctcctgcctcggcctctgaaagcattgggattacaggcatgagccactgtgcctggcccagacaggcccagacttctttaccatggatgagatctttgtcaactcagtgtggccatctcacgctgctttgtcaacaagttctttttttttttttttttttttttttttttaatgagacagggtcttactctgttaccaaggctgcagtgcagtggttcaatctcggctcactgcaacccctgcctcctgggttcaggcaattctcctgcctccgcctcctgagtagctgggattatgggtgcccactaccacacccggtggtacataataataatttttctatttttagtagagacagggttttgccatgttggccaggatggtctcgaactcctggcctcaagtgatccgccctacgtggccatccaaagtgctggaattacaagtgtgagccaccgcgcctggccacattctatcatttttatattggtttagtccatcctgtctttgattccactgccattgcttatttcagatcattgctgtttctcatggagacccttgatactcagagtgtggtccatggatcagagtctcaacatcacctgggaacatctaggaatcttagatacccacctcagactctctggattagaatgtgcattttaacacactgaaatttgacaagcactaataaattttttcactagagtcttccaatgatctcccgactctagtttggttttgttttttcagagatagggtctctctctctctctctctctctctctctctcacccagttgagagtgcagtggtgcactccatagctcactacagccttcagctcctgagctcaagtgatcctcttgcctcagccttctgaatagctaggattacacatgcatgccattacatgcagctacgtttctactttttgtagagacagggtctcactatgttttccaggctggtctcgaactcctggcctcaagagatcattccaccttggcctcccaaagtgctgagattagaggcatgaaccactgcgctgggcccctgcctctagtttttttgtttgtttgtttgttttgagacagagtctcactctatcacaaagtctagagtgcagtggcgcaatcttggctcactgcaaactctgcctccagggttcaagcaattctcctgcctcagcctcctaagtagctgttccaagcattttgagaggtggaggtgggcagatcgcttcagcccaggagttcaagaccagcctggacaacgtggcgaaacccatctccaccaaaaatacaaaaaattagctgggtgtggtggtgcacctcagtggtcccagctagacaagaggctgaggtagaaggatcacttgagcccaggggcggaggttgcagtgagccgagatcctgcaactgtgctccagcctgggtaacagagcgagaccgtgaacattaaataaaaatggattgtctaggggagagagaagttgagaccaaaatagttcaatgctagtagagagtaagggacagagtataggttaataaatttagatttacctaggtagtatcagccagatttgtaggtcaaagtacaaatttacggccgggcaccgtcccagcactttgggaaggtgaggcaggtggatcacttgaggtcaggacttcaagaccagcctggccaacatggtgaaaccctgtctctagtaaaaatacaaaacgaaattagccaggtgtggtggcgctgcctgtagtcccagctactagggattctgaggaaagagaattgcttgaacccaggaggtggaggttgcagtgagctgagatcatgccactgcactccagcctgggccacagagtgagactgtctcaaaaacaacaacaacaaaaacaaagtacaaatttactggtttcaatgactagctcaaacaaaggtgtcatcagctgtcataggaaatacacaagataggatctggaggaagatattaaatttgaagtgcttctgggatatctagtctagtggtgctgcccaacaaagagttgtatagacacatctggaaatataagttcgtaaacttttagcatgtctttactcactttactgtttagtttaggtgaacctttttccagagggtaactcccctgcatagatgatggtaaaaaactgtagagactaaggttggggttataaatacacagtaaatataggtagaatgcaaggaattttttttttttttttttttttttttttggagagacacgatctcaccaagttgcccagcctggccttgaactcctgggctcaagcaatcttcgtgccttgaccttccacagtgctgggattacaggtatggggtaccacctccggccagatgcaaggattttatttcctggatggagcagcattttggagcatccagaaatatcagccctgtatgcaaggggatgctgttgaatcaattccacatgaaatagacaaggcatactagcagttatgttaggatgttattatttgagccatacacagatcagggggcactttagaatttttcttctgcttactcagttcattcatacgttcaacaagcattggctgggtatctaccacgtgcctttcaatatttcagctctgatgatttgaaagtaaatagaacacatttctacttcatgggtatcctcatgtaaatatgtgatttataaatgagttgtattactcacgcacatttcttttcttttcttttctttctttttttttttttttttttttttgagacagagtctcactctgttgcccaggctgcagtggtgtgatctcggctcactgcaacctctgcctcccaggctcaagcgattctcaagcctcagcctcccaagtagctgagtagctgggattacaggcacacgccactacgccttgctaatttttgtatttttagtagagatgggatttcaccatgttggccaggctgatctcaaactcctggcctcaagtgatttacctgcctcggcctctcaaagtgctaggattacaggcataagccaccatacccagccctcacacacacttctggtgagtataacttggcatgacacttttgaaggatggcttgataatataaaatgcctttaaaaatgtgcatatcctttgattcagcaatttcacatcaaggaatttttcccaaaagaataagatatctacaaagctttaactgcaagactgctcctcatattttgctgataatctcgagaatttaggaataacctgtttgtccccagaaccaaggagattggttatataaattattctatagctagcaggaaaccagtggatgattttctttttaatttttttttttttttcagagacaggttcttgttctgtagcccaggctggagtgcagtggtgtggtgatcacagctcattgtaacctcgaactcctaagctcaagcgatcctcccacctcagcctcccaatggaggtttttaagcaggagagtggcattggatgtgtgtgtgtgtgtatctaattttagaagtcgtgtggagaatggttttcagtagggagaaaaaaaacccagaaaagatgttttttgccacagtgtaggtcagagatgatgcaaaattgagctaacttaggcagtaggaaggaggaggagaatcagatttgggagctatttccaaaatagagtcaataggatttgttgactgactgtggcagagagtgttgggatgttgcagaataaggtaccaaggatatactgagatttccaactcggatggagcaggtatgggggctgatatagtgaatctgactttgaatatgatcaggttgaggttataaatccctcttcatgggcactgccatggtggtttcttgaaacacctttgagaggtgatgtgggatgtggcgaagtgtttaggctttgagactggctggctgagtttgaatgctggttctgccatgtgttagcaagtaatttacttacccaaactctctgagctacagcccctgtctcacaggatactacagcatagaatgaagaaggataaatctggtacagtgcccagcacatagtaaccacgcaataaacatcagctttaaaaaaacagacaatgcgggctgggcgcagtggctcacgcctgttatcccagcactttgggaggccgaggcaggcggatcacaaagtcaagagatcgagactatcctggctaacttagtgaaaccccgtctctactaaaaatacaaaaattagctgggcatggtggtgcatgcctgtaatcccaactactggggaggctgaggcagaacaatcgcttgaatctgggaggcggagattccagtgagccgagataacgccactacactctgacctggcgacaaagcgagaaagcgagactccctctcaaacaaaaaacagtcaatgctgcctgtaatcccagtattttaggaggctgaggtgagcagattgggctgaggttgggaattcaagaccagcctggccaaaaggtgaaaccctatctctaccaataatacgaaaaattagccaggcgtggtggttcatgcctgtaatcccagctacttgggacaggcgtggtggttcatgcctgtaatcccagctacttgggaggctgaggcaggagaatcgtttgaacctgggaggcggaggttgcactgagccgagatcgcgccattgcactccagcctgggggacagattgagactccatcaaaaagagaaaagaaaaccacaaaaaaactcagacaattctataatagagggagaatacgcatgcaacccagggatttttctcagataccctacccattctcaaatagcatgtgctctaagctcctatggtaaaagcttcatgcccctgcaaaactcacacacctgatcccactcctcaagcacttcatggagaagcagcagctcccagctctataacagataggggatttcaggtcctaagtcttgagagcaaatatttcctcaacttcttttctctctctcaagcctcctttaagaggaatacatactatgctttctggaactctgttctaccttccaaacccatttatatcttttacgattttttttccccaagattgcggatattttctattttttttctggagacagtctcgctctgttgcccaggctggagttcagcggtgcgatctcagctcactgcaacctccacctcccgggaggaactgccagaccatcttccaaagaggttgcaacattgtatattcatggtatgagagatctaatttttctactcaatgtcattttaatggtgtggtgttttgttttgttttgttttgttttgttttgttttgtttgagacaggatttcactgccactcaggctggagggcagtgatccagtcatagctcactgcagcctcaacctcctgggttcaagtaagcctcccaccccagccccctgagctgctgggaccacaggcacatgccaccactcccggctaattttttaattatcacttgtatagatgggatctccctatgttgcccaagctggtcttgaactcctgggctcaagcaatccttttgcctcaatctcccaaagtgttagtgagaggtgaagcccgctgcatttcctgtatggagtggggacttggagaacttttctgtctagctaaaggtttgtaaacgcaccaatctgcactctgtaaaaactcaccagtcagcgctctgtgtctagctaaaggtttgtaaacgcaccaatctgcactctgtaaaaacgcaccaatcagcaggacatgggcagggacaaataagggaataaaagctggccacctccaaccagcagtggcaacctgcttgggtccccttcaacgctgcggacgctttgttctttcgctcttcacaataaatcttgctgctgctcagtctttgggtctgcaccacctttgtgagcaataacactcactgcgagggtctgcggcttcactcctgaagtcagcgagaccgtgaacccaccggaaggaaaaaactccagacacatctgaacatctgaagaaacaaagtccggacacaccatctttaagaactgtaacactcactgcgagggtccacagcttcattctttaagtcagagagaccaagaacccaccagaaggaatacattccagacacattaggattacaggtcaatgtcattttaataggtttttggttttgatttggagacttcatttggtaaattctcaaagagtcagcactcaaaatatcagctaacacgttgcttcaacccaagaaggatgatgatcatgatgatgatactaacttgtactgaggacctcctatgggctgccatactttatctcatttaatcataatagtcctctggggctgggtgtggtggttcatgcctataatcccaacactttgggaggcctagtcaggcggatcacctgaggtcaggagttccagaccagcctggccaaaatggtgaaacctcgtctctactaaaaatacaaaaattagccgggcctggtgatgtgcgcctataatcccagctactcaggaggctgagacaggagaatcacttgaacctgggaggtggaggttgcagtgagccaagatcacactactacactccagcctgggcaacagagtgagactccatgtcaaaagaagaagaagaatagtcctcaccactacactccagcctgggcaacagagtgagactccatgtcaaaagaataataataataataataataatagtcctcaccactacactccagcctgggcaacagagtgagactccacatcaaaataataataataataatagtcctcagaatagataataatgtcattagcatttgaaagaaagtgaagattaaagaaattaagggacacaacacacagagtcacacagccagcaggtggcagagtcagggctcaaactcagatcctctggatttcacggcccgcatttttgaaaaccatgcgattctcataagctcagtgtcatggacgtttgaaattctcaacatgctggatgaagtatcaaattaccaggatgagattgcattatttttcctttcaatcaagcaaaatgacagttataaaagtgtcttgcactggcccctgctgccttggctctttataatcacccaggatccctccaagtccttggcattcccagcaaagccgaggcactgagccaggacaagcagccagggctcgggggcggtggcgggggggtgagggggtgaaggggagggtgtgggggggtgttgctgcttaatacttccatgcagatggtgacttcagccagttactgaacttgaagcattatcaccctatgctaatgcaaacagacagggttctggggactgtggtggcagggatagtttgtcctctaggattgtggaattgtattacacacttttagaaatgaaatgtattcgtttttgaattctaaaacaatatgggctcaatatagatggttggaaaattcataaaattaaaaaaaaatctttcccaaatttcaactctagaaacaaccattgttaatattctcttgtatttactgctagtcattttatttttcataccttaaaaccattatttattgctgggcgtggtggctcacgcctgtaatcccagcactttgggaggctgaggtgggcggatcatgaggtcaggagatcaagaccatcctggctaacacggtgaaaccccgtctctactaaaaatgcaaaaaattagccgggcgtggtggcgggtgcccgtagacccagctactcgggaggctgaggcaggagaatggtgtgaacccgagaggcagagcttgcagtgagccaatatagcaccactgcactccagcctaggcgacagagcaagactctgtctcaaaaaaaaaacaaaccaccattatttatttatattttagagacagagactcactctgtagcccaggcaggagtgcagtggcacgatcatagctcactcactgcagtctcaacctcctgggctcaagcaatcctctcacctcaacctcccgagtagctgggactataggtgtatgccacaacagctggctaattttttttttttttttttggtagagacagggtcttgctgtattcctcaggctggtcttgaactcctggcctcaggcaatcctcctgcctcggcctcccaaagtgctgggattacaggtgtgagccactgcacctagcctgatttcttttctgattataaaagtaatacaggccgggcttggtggctcatgcctgtaatcccagcactttgggaggccaaggtgggcagatcacttgaggtcaagagtttgagacgagcctggccaacatggtgaaacctcatctctactaaaaatgcaaacattagctgggtgtggtggtgggcacctacactcccacctacttaggaggctgaagtgggaggattgcttgaacctggcaggtggaggttacaataagccgagatcaagatcgtgccactgtactctagggtgggcaacagagtgagactatctcaaataaataaaagtaatacgtatactttgtagaaacattggagaatacaaacaaaacatttattatcatgacatacataggtagtcactatcaatattttggtgtatgacattttagtgttttttcaccctggatgtgtatacatgtttgtatatacgtaaacaggtaaaattggaatcacagtagccgggtgtggtagcccatgcctgtaatcccagctctttgggaggcagaggcaagagaatcacctgaggccaggaggtcaagacccacctgggcaacatggcaaaaactacatctccgctaaaaatacaaaaattagttgggcaaggtggtgcatacccgtagtcccagctactaaggaggcctgggcgggaggactgcttgagcccgggaggtgagcagtgagccgacatcccaccacagcacgctagcctgggtgacagagcgagactctgtctcaaaaaaaaaaaaaaaaaggaatcacagtatttttaaatttctaccattatcattctataaaatatgattgagattacagtgtgcacttgatcttagccaaaagatccagaatgacagctcacactttatattacaatttgtattctacttttcctgatattttgattaaattgtgctatgttttccctatgacatttccctattacatttctttgtaaacatcattttaaataagtgtacagtgttacattgcaggcataccataagtttagccatttcccttttgtaagatactgacccttttctaattttttctacagtttacataaattgtaaaaaaaatatattgtgtgaatgtatttttagtaattcagatattccttcgggtagatttccatgagttgaatttttagatccaatagatgtattttttcttttttaaattataaaatattttaatgtagagataattacatgacaaagatccctaaatgcaccaaccgtcttttaagggatacacacccttttatttatatattatgtctgtaagattcatccattttgttggtagtaatttgtttgtttttttttttttttttttgtgagacagggtttcactctgtggcccaggctggagtgcagtggcatgatcacggctcactgcagcctgaacctcccacgctcaagtgatcctcctgcctcagcctcctgagtagctaagactacaggcacacaccacccatgcctggctaatttttgtattttttgtagagaagggattttgccatgttgcccaggctggtctcgaactcctgggctcaagcgatttgcccacctcagcctcctcaagtgctaggattacaggtgtgagccattgtgcctggccagtagtttggtctttttcgttgctgtgcagattcagttgtatgaatatagcataatttttgtccattctattgttgatagacatttgagttgttttcatttcttgtcattatgagtaaagctcttaacattggtggacacaagtatgtatttctcttagggatatatccaggaatagaattgctgccagacagaaaaatatatatgtatttgtagctttagagggtattgccagtctttttttatttctttcttttttattttgagacagtctcactctgtcgcccacgctggaatgcagtggcgcaatctcagttcactgcaatctctgcctcccgggttcaagcgattctcctgcctcagtctcctgagtagctgggattacgggcatgtgccatcacgcctggctaatttttgaatttttttagcacagacgaggttttgccatgttgggctggtcttgaacccctgacctcaggtgatccgcccacctcagcctcctaaagtgctaggattacaggcgtgagtcaccacgcccagccattatctctcattttctaaagtggtagtaccattttatactccgaacagcaataaattgtagttacattcttactaactgctaactcatttatttactagcatctggactaacatttggtattgtcagtctttttaattttagtcattctggtaagggtgtagtgcccaccagccatctccaacagattttaacatatatgcttcagatctcttttaagaaatataaatttaaatattcattagtgaatctagtaagggatgtgtgtgcgtgtgtatatatatatatattgtatatatacacacacatatacaagaaaataacatacatattatataaaataacgtatatatacacatactgtatatatacacacacaaactatatatatatatgtgtgtgtgtgtgtattttggagacagggtctcactctgtcatctaggttggagtagagtggtgtggtcttgcctcactgtagcctcgacctcccaggcccaagcagtcctcctacctcagcctcctgagtatctggaattataggtgtgtgccaccacacctggttaatgttttaatttttgtagagatggaaaactgctttgctgcccaggctggtctcgaactcctgagctcaaggattcctcccaccttagcctcccaaagtgctgggattataggcatgagccaccgcacctggccaaggtctgtatttttcttattgtactaaacttgcaacttttctgtagatttaaaaattttcaaaatactgtaaatagtttaaaaatatataaattttagatatagctgaaactaactacttaccctttcccagcctcctaaagtaattactatcctgaatgtaatgtttattgttttttttttttttttttgagacagcgtctcactgtcactgaggctggagtgcagtgtcatgatctcagttcactgcaacctccgtcccacgggttcaagtgattctcctgcctcaacctcctgagtagctggaattacaggtgtgcgccaccaggcccggctaatttttttttttttttttttttttgtatttttagtagagacggggtttcagcatgttggccaggctggtctcgaactcctgacctcagactaaccgcccgcctcagcctcccaaagtgctgggattacaggcgtgagccactgtgcctggcctggtacaactaattttaaaagcaggttgacactctagtccaactggcagatgtgcataccccatgccattgtaatttttccccctagaaaaactcctattcagtcgtacagggaaatgagtataaaaacatttgctgctgccatgtttgtaattgtggacaattgggaataatctttatacctcatcaatgaaaaaatagaccaattatggttcattcatgtagaatactatacagtagactatgaaccagagttacatgaatcagaattcgtatttctcaaaagcataatgtgggccgggcacggtggctcacgcctgtaatcctagcactttggcaggctgaggcaggtggatcacttgagcccaggaattcaagaccagcctgagcaacacagtgaaaacctgtctctatctttttaaaaggaagaaaagcatattgtggaacaacaacagaaaaaagcaacttgcagaattataaagtatgatatcatttgtataaattataagaaaatgttaaatagcgctattatatataatttgtagagttatacatatatacctgagaacaataaacattacattcatgcagccaggcacagtggctcattcctgtagtctcagcactttgggagaccaaggcgggcagatcacttgagctcaggagttcgagaccagcctggccaacatggtgaaaccacatctccattaaaaatacaaaaaattagctgggcatggtggcacgcctgtagtcgcagctactcaggagcttgaacccaggaggtggaggtttcagtgagccgagactatgccactgcactccagcctgggtgacagagagaaaaaaacagttgtaccaatttatactcccactagcattagataaaagttcaaattatgccaggcatggtgtctcacatctgtaaccccagcatttttggactctgtctcaaaaaaaaaatccacatcttttacaacacatgattgttagattttttagtttttgcctatcggatgatatattcttatttacattttcattttccttattactaagggggttgagcagcttctcacattaggccttcctcctctgcccacatgacatgactattcatattctttccctgtttcctactgggatatcattttctttttttcgtttcttttctttttttgagacggagttttcctcttgttgcccaggctggagtgcaatggcatgatctcggatgactgaaacctctgcctcccaggttcaagcgattctcctgcctcagcctcccgagtagctggaattacaggcctgcgccatcacagctggctaatttttgtattttcagtaaagatggggtttcaccatgttggccaggctagtctcaaactcctggcctcaagtgatccacccacctcggcctcccaaagtgctgggattacaggcatgagccatcgtgcccaggcactgccatggtgttttttgtttgtttgtttgtttgtttttaaagataaacctctggggtttctggaaagtaaagccccatgctccaaacagctctgctatacctgtgtgcaaaatattttcatctctctctctctctccccaaagtgcatgcaaacacatatggaactgacataggcatccactgtcgcacttcaaattaaacagacgcacacgacagatattctcacagaaaagcagtcagccaagcccagaacccatagatctaggtccacactcacgcctctgcatgctccccagaaagacggatgcatcgcccgcaggtagagacgggctcaccaatcccactcaaaacccgctgccggcttacagctcgcaagccgcccacagtgccagccccatgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggcttggggcggcaaaagggtcaaaaggcacacaccgttctcttttctctcttgactcagttaaagtctgcttgggcacaactctagaaggcagtttcgaaatagaccggctgtatttatttactggttctctctgcggtgtttggatgtcaacatttctaagtaaacgaaggattttgtttttcattaataggatacaatagttgaaactcctgccctcaaagtgtagaggcagcgtcaggggctccagggtcactggaggtccctgcaaacccgggggctccccaaagccgctgctctcacatggcttgcccaccaggctgggaaggagaggtccttctcagggacccggcagcttcctgcctcggctctgggtcactgctccgcgctctgccccagcacggatctctgagcgatgtagggctaaagtattgtgaatgtgatcttattctgtcctcacctggtggaaaattgtgtgtgcgcgctttctttctctatacctgtaattatggatttagaaaatcttcctagaagggctcaactgtgttctgattctgacgggttgaagttgaaatcacaatccaatgtcttagtggttcatgggctaggatggatgtcatagcactgccaacctctttccttttctttttttttctccctttttaaccttggtctttctttctagttcatcctttcaagacccaatgacttggtgctttggcataatatcagggcgtcagggctgagggtctctgtttctttctttaatttttaagtgcacatagtgggtgtccatatttatggaatacatgagatattttgatacaggcatacaatgtgtaataatcacatcagggtaaacggggtatccaaaacctcaagcatttatccttttttttgtgttacaaacaatccaattacactccttttttaaaaaagcccagctgtgtgactaattatactcttttagtttagcttttttttttttttttttgagacggagtttcgctcttgttgcccagactggagtgcaatgacacaatctcggctcactgcgacctccacttcctgggttcaagcgattctcctgcctcagcctccagagtagctgagattacaggtgctcgccaccatgcctggctaacttttgtatttttagtagagatggggtttcaccatgttgggcaggctggtcccgaactcctgacctcaggtgatcggcctgccctggcctcccaaagtgccgggattacaggtgtgaggcaccccacctgccctcttttagttatttttaaatgtacaataaattgttgactgtagtcatcgtgttgtgctatcagatactagatcttattcattctatctacctatatttttgtacccattaaccatctctgtgtccccccatcccaataccctccccagcctctggtaaccatcattctactctgtatctccatgagggtctcttgtttcttacaagctcaaaataatctcaacaatggctgccttttattgctagatgaccatgtgctgagaactctaaatgcatcatttcatttagtcccctcaacaacctcctgcagtactaagatttataaatttaaatcttgcctagatttaaaaaaacattttaaaataaaaattttaaaacaaaacattttaaaataaaaaatttaaatataaatttaaaatcttgcatagatttaaaaaaacaaaacaaaactgggacttgttaggtgatctgacagttaagtggcagaaccaggatttgaaccccggtctgttggaccccagagcctgcttttaacatgaaggtttattgctttcatggtttcagaaaacttcctaagtctattgagatagtcacagaacatgctcagtgattttataattatgtggcagccctgttgctctctgaagctcacagaggccttaaaaaaatgctgggtccacgcagaatggaagctgttcacaagagtgctgctttgaatcctcactctgtgccttgctggctatgtgactttaggagtattgctaagcctcactctgccttcattttctgaaaatagagattatgtctttattgtgtatactaaataagatgatacatatagtactcaaggttaagtgctcaatacgtattgttcacttccattcggttactgcacaacatttatagacagaacctgcttttactctttgcaaggaattatgtaaatattggtcaattcttcaataatgcccttgtagctttttatatcttaacattttatgagaaaaaatttgaaacatgcaggaaaattgcagcaagcacccaatttacagcagtttcaatcctgaaatttttgtacttctgggtcctatgctgcacactgttaaaagtcaggtataaggccaggcgcattggctcacgcctgcaatcccagcactttgggaggccgaggcgggcggatcacaaggtcaggagatcaagaccatcctggctaacacggtgaaaccccatctatactagaaatacaaaaaattagctgggtgtggcagtgggcgcctattgtcccagctgccggggaggctgacacaggagaatggcgtgaacctgggaggcggagcttgcagtgagccgagattgcaccactgcactccagcctgggtgacagagtgagactccctctcaaaaaaaaagagtctggtataaagtccttcttaccctctgtttcaaaccatcaaagactcagtcttgcttcctagtcaaaggcaagaggaacagctcctgatctgtacttgcgtggatcctcaaatctggtttttcttttcttttttgagatggagtctcactctgtcccccaggctggagtgcagtggcatgatctcagctcactgcaacctccgcctcccaggttcaagccattctcctgcctcagcctcccaagtagctgggactacaggcgcctgccaccacgctcaactaatttttgtagttttagtagagaggggttttcactatgttggccaggctggtcttgaactcctgaccttaggtgatccacccacctcagccttccaaagtgctgggattacaggcatgagccaccacacctggcgaaagctgaaattcttaaaacgtggatccagagtctaacttttgaaacttgaatctggcaagttttattttctagactatttttttttttttttgagacagggtcttgctctgtcgcccaggctggagtgcagtggcacaatcagctcactgcaacatctgcctcccaggttcaagcaattctcccgcctcagcctcccgagtagctgggattacaggcatgcaccaccacgtccggctaatttttgtatttttactagagatggggtttcaccatgttggccaggctggtctcgaactcctggcctcaagtgatctgccctccttggcctcccaaagggccgtgattacagatgtgagctaccatgcctgggcctgttttctagatgcgtgtttgcacgcagggggtgtttgattaaaccttttttggaacactctttcaactctcagggtatctatggatccattccataaagcctgggccctccatttatttattaagtgtgaaaattagtacttttgtttctatggcatgacaattgccaagccaatgttgtaacacatgaaatgctggagaaaagaagagtccccttaaaaagaagacatgctctgtttaacttccacacattttaaaatattttatgttaaacactgagtaggtgtaaattaaacagaattgaagaggggagggagactgcagaactggtcttttttagttaagattgtgttgactgctattttaaatttcaactatagtttttagataaaagatatgtaatgtgctatatcagagtagcaaagaaggaacgttttgaagttaggctgaatgagttcaaaccagcctcattcagctgtcacttggtagatttgtgaccctgggaaaattgctcaaggtctctgtgtgtcagttgcctcatctgtgaaatggggataattgtagtaatgcgcacttcggactcttggaagattagatgagataatgtatataatgcatttagcacagggcctcacatgctgaaagcgctcaatcaaggttgaatggttgtcataggaggacagaaggggattgccccagcaatatttgcagaggttatcccaaactcaccagttacagcttttcattgcttccatttcttagtaaattctggttaatgattctgtacatactgccttcctcatgggaacatgtggagaaaggcttctgcacccttacaaaccatctagtattttctcctttgagaaaggttcaaagtaattgctcccagccaccttcaacagcgtttttccactagcagggaggttttttccccgctcagctggaaaatgtatagtgacatttcagcgtggttagatatataaaaatactgctttcaaccaagtgtaattaattgagggagacatgcagacaaggtgccttttgaaaaagcgcagagcttttcagaaacacagttgtctctgttgtggccatttcttgatagatttgtatgtgtcttaaaggatgatcaagattttggacaggggaaatggaggagttggaggcgggagaggggaatgccaggagaggtaatagcatcaactggctgggtgtggtggctcatgcctgtaatcccagcactttgggaggctgaggtgggcggatcgcttgaggtcagcagttcgaggccagctgtcccaacatggtgaaaccctgtctgtactaaaaatacaaaaattagccaggcgtggtgatgggcgcctatagtcccagctactagggaggctgaggtgagagaattgcttgtactcaggaggcagaggttgcagtgagccgagattggacggctgcattccagcctgggtgacagagcaagacttaatctcaaaaaaaaaaaaaaaaaaaaaaaaaatcaacacagacatagtgctggaaataaatgctctatgagtaggagattggaatgaagtagagagctcaaactgcaatctttccataagcccgggggagatgactactatttaaaagttcaaagttgtgtactgactaacaagcagatcgtaaaactggccagcgtttcaggtttcataaacagtgtggaggctgaaataatgcaaattgctggcaatctatataatagattcttggggaaaggtttgaactatcttctgtttggttacatatgctcattttattattttattttggttttgcatcatttctttttttctgattctagaagtaatacatgtactttataaaaaatttgaattcatctgaaatatgaaaataaaaagtaaaaaacgaccatcatttgctccccagatcccatttattcactccataaataggtactgagtgccttacaagtgccaggaagtgttctaggggctgcaggtacagtcttgagatttctcgacaaagtccctgcccacataaagcttctgtttaggggaagttaagacctgggttgagagtgaaggcgtcaaatattacataagcaaacaagtaagatggtttaggtcatagtaaatgtttcatgggcattaatagggaaggggtacttttcatttggtgttcaggaagcgcttctctaaggaggtgacattttgctgtatcaatagcaggaatccaggcagtaaacgtaaaggccttgtgctagaggaagagacagaaggccagggtggctggaacccagtgagtcagggtgaagggcagatgaatcagagggaagccagactaggtagggccttttaggttgtgattaaaacaaacaaacaaaaagtctgaaatttattctcattgcaggagaaactgctaaaaaattttaatcaagggactaacatgaactgttatgttttttgaggttttttgtttttgagacagggtctcgcttgtcacccaggatagagtgctgtggtgagatctcggatcactgcagcttcaacctcctgggctcaatggattctcccgcctcagcctcctgagtagctggaactacaagttcgcatgcctctagagcccattaaaaaaaaaaaaaattaagacagagtctcgttctcttgcccaggctggagtgcagtggtgtgatcttggcttgctgcaacctctgcctcctgggtccgagcgattcttctgcctcccaagtagctgggattacaggtgcccaccaccatgcctggttaatttttgtatttttagtagagatggggtttttccatgttggtcaggctggtctcgaactcttgacctcaagtgatccacctgcctcagcctcccaaaatgctgggattacagccgtgagccacgatgcccagcagccctgttagtttgtgaatttttggtagagatggggttttgctgtgtttccaggctagtcttgaactcctgggctcaaaagcaatctgcctgtctcagcctcccaaagggctgggactacaggcaagagccactgcgcccagcctggtttttgtttttaaagggtcatgttgggtactagatggggaataagtccatagcggggcaagtgatgatcaatgcaagcagcatttgatatagtccgtgattccttcctaatcaattttattttggagaagtggtggcagtttccttgagtgtgaaaggtgtgacaagggccccatgggttgtcctctggaagatcaagcacctggttaagacttaggagagggaggccgggcacagtggctgaagcctgtaatcccagcactttgggagaccgaggcaggtggatcacctgaggtgaggagtttgagaccagcctgggcaacatggtgaaaccccacatctaccaaaaatacaaaaattagctgggcgtggtggcgcatgcctgtaatcctagctactcgggaggctgaggcgggagactcacttgaaccagggggcagagcttgcagtgagctgaggtcacaccattgcactccagcctgggcgacagagtgagacactgtctcaagaaaaaaaaaaaaaagaattaggagagggatagattctgcactgtctcttgacaggcaactatgtaagttattgcaaaactattatagcagtgatataaatattacaaatatgatagtatctagaatgtactttgaacaagcccaattatttacacagttgagtaatgtctgctcataactttgctcataacattatgttttatttttgcaagagtttcctcctgtgttaattgaagaaaaaattaatcatgcctattcttggactgattagttattaaacacatattaataataatatccattcaatgagttttagctatgaacttgagcttattaaattctcataacagccctatgacataaggagaattattattcccatttaaacatggggaaaccgaggtttcagggggttaagaaacttgctgaaaggcataaagctagaaggtggtagggctggagcctgattctaagccctctctgcctctggatgttcctatccactgtctgttattcttggttcagtgctgggtgctgtagagattagagatggaataagacagaatcccagccttcactcttaaaaggtttacagatttggagtgagagacacagccataaagaacaccacagggccgggcgtggttgctcacacttgtaatcccagcactttgggaggccgaggctggtggatcacttaacatcaggagttcaagaccagcctgagcaacatggtgaaaccccatctctaccaaaaatacaaaaattagccaggcatagtggcatgcatctgtaatcccagctactctggaggctgaggcaggaggatcacttgaaccggggaggcagaggttacagtgagctgagattgcaccactggactccagcctgagcgacagagcaagacctgagaccctgtctcaaaaaaaaacaccacaggctgggtgcggtggctctcatgtgtaatcccagcactttggtaggcccaggcagggaggattacttgagccccagagtttgagaccagcctgggcaatgtggcgaaaccctgtctctaccaaaaatacaaaaaattagctggacgtggtgctagctacttgggaggctgaggtgagagaatcgcttgagcctggggggcccggaagctgtggtgagccaagatggcaccactgtactccagcctgggcgacagtgaggccctatctcaaaaaacaaacaaacaaacaaaaacaaaaacaaaaaatccaccgcaacttataaagcagtataatgaaacacatgctaaatgaaaagtacaagtgtgggccaggcatggtggctcgagcctgtaatcccagcactttgggaggccaaggtgggaggatcacctgaggtcaggagttcgagaccagcctggccaacatggtgaaaccctgtctttactaaaaatacaaaaaattagccagatgtggtggtgcacacctgtgattccagctactcgggagcctgagacacgagaatcgcttgcaccctggaggtagaggttgcagagattgcaccactgcactctagcctgaacaacagagcgagactctgtctccaaaaacaaaaaaaaaagtgtgaaattaggaaagaaattggctgtgactggggagctgcaggccaacagcaaagaggggtgtttgcattgggcctgaaggctaaacagggtttcaaaagaggaagagtgtagagaaggggatttcaggtaagctgtctgccccaggcacagaggtgaatattccaaaggccagggtccaggcaccagctttgtttttttttttttttttttttttttttggctgtttctttccccttggcttaatggatcctgggactgcctggttcacttatatgaatgggcttgggggttggttggaagccagcacaggtaaaggccctcttttagtacttcactcacaagttcccccaaaagatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctctgttttgcagacgatatttattgagaaatgcctgccaggctgggtgggaggagctggcctcatagtatgagtacatggtggtcctgcatggaagagcagatggtttctagtttattggttataagtgtgggctttcgagagagcttttattttgaggcctggctctgccatgtcctggctctggactttgaatgagttatttcacctttttttcccccacctcaatcttttgctatctgtatctgttctcaataataaccatgaggaattatataaatctgaagaagtttctcaaagtcagtttttgagacagggtcttgctccattgcccatatgggagtgctgtggcacaatcacagctcttgcaagcctcaacctcctgcctaggcctcccgcctaggcctccgaagtagctggaactacaggtgcacaccaccacgtgtggctaatttttacaatttttttgtagaggtggggtcttggtatgttgcccaggctggtcttgaactcctggcctcaagcaatcctcctgtcttggcctcccgaagtgctgagattataggcatgagccaccacgcctggttatttcacctcttaagctttggtttctgcaactgtacaacagtgacagtaatagtatctacttaggatagctgagaattccttgagacacagattggaaatcattcaatacagaggtcagtacatgatacatgtttagtaaatgttaattattatattattggctttacagctatggcaacaggtacataaaaaggtaaacttgatttaataagggtgtgtgagtaagtagggggctggcagcagggtagctaatggagcaaagaggaggggcttagccaaccctggggcttctgaaaacttctggaagagctgagccttaataagaaagaatagaaggaaatacatatgtggaatcaccattaattgttaggaaaaaccaaattggaaccttactgagatatgtagccactggaaaggctaaaattaaaaggactgatcatactaagtgctggagaggatgtagatcaactggcaccctcatgccttgctggtaggaatgtcacatggggggaaatggcttggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacttaaactattgtatacagacagaaagtaagcgagactctaactctacaaaaataaaaataaaaaagttagctgggcatagtggcccacgcttgtgatcccagctacttgggaggctgaggcagaatggcttgagcccaggagttcaagaccagcctgggcaacatagcaagtcctcatctctacaaaaaaataaaaaaataaactggctgagtgtgatgatgtgcacctgtagtcctagctacccgggggctgaggtgggagaatctcttgagcccaggagtttgaggctgcagtgagctatgactgcaccactgcactccagcatgggcaacaaagtgagaccttgtctctaaaaaaataaagaaaatgattataagaaataacatgcatgaagttcttcctatgagccactgtgtgcatgttttacatgcatcctccgctccttacaaaacgttctgtgagatgagacacaatatagccatctattgcatttattgttctatttacagaggagcaaactgaggcttacagaggttaagcaattggcccaatgtcactccactgataagtggtagggctgagatttgaacctagcacaggttgacttaattctgctaccttcctaatttcccaggattagttgaagctgccattgatatagatgcttaatgtcaactagacacatctctgtgtttcttagaactgattctgttctctggctcattaatttccttttccattacaaacatgcctcttgtaagcttgaggactacatctcaccacttcaaagtgccttcagtgtcaaactggagtggaagttgaagacgttcacaaaaatggaggagggagagcctttctgttttgaagacttgtagcttcacaaagaaaggctttctttgaatgatcaagaaggatttctaggtcaatataggggcatattactgtaacgtttggcagcaggagctctgcctgcatttgaatcctggctttaccacttcataatagttgcgtgatcttgggctagttacttaacctctctgaatttcagttttctcatctgtaaaatggggataataacaggatctgccccaaaggatgtattggtccgttttcacactgctataaagatactacctgagactgagactgggtgatttgaaaagaaaagagatttgattgactcacagttccacctggccgaagagtcctcaggaaacttaaaatcatggcggaaggcacaggagaagcaagcaccttcttcacaaggtggcaggagagagtgacagagggaagcaccagatacttatcaaacaaccagatctcgtgagaactcactcagtatcatgagaacagtatgggggaaaccgcccccatgatccaattacctcccaccaggtccctccctccacacatggggattacaattcagattacaattcaagatgagatttgggtggggacacagccaaaccgtatcaaaggctaattaagaagattcaatgaaataatacatgaaagcccttcacagagtctggtgctctcagtaaatggtggcgatcatgttaatagaagaggatgtgaagtgggaattgacctgatagtatctgaatagttggagagaaggaagagagagaagttaaatttaagtgggtgaacctcaaggaagaatggaggtgacgatgagcgtggagatttctggaggcgtgcatgagcttcgctgcattggaggagttgtgagataaaaaggatggttaagcaggaccactagactttggtggattaaaaaaggactggcaatatggggccattggaggacaagggatggagggaaagaagtagcatttatttatttatttatttttgagacagagtcttgctgttgtctcccaggctagagtgcagtggcgtgatcacggctcacttcaacctccacctcctgggttcaagcgattgtcctgcctcagcctcctgagtagccggaattacaggtacccgccaccatgcccagctaatttttgtacttttagtagagatggggtttcaccctgttggccaggctggtctcaaactcctgacctcaggtgatctgcctgccttggcctgccaacgcgctgggattacagacatgagccactgcgcctggccggaagtagcattttaggaaggcttgtctggcaatggtgaccaactggatgcaaagtcaggggccctggggataagaaggtcagctaggagggtttggaattatcccatgatgagggctgtatgtccaaatatccatggcagggctggagtctgcaggagcagtgggtttgaaagaaggggctgatcagaaatcttgaagggagaaacccatagtagttattatgtctcagaaggaaagaaggtcttctaagtgctctcaatgtgataggcaaggaaaaaccctgtcattagcctgaggtcttaaccagttaaaaatatcagcatccaggcgcagtggcttacgcctgtatttgcagcactttgggaggcccacgcgggtgggtcacttgagttcaggggttcaagaccagcctgggaaacgtggcgaaatcccatctaccaaaaatataaaaattagctgggcatggtggtgcaagcctgtaattccagctactcaggaggctgaggcatgagaatcgcttgaacctgggaggcagaggttgcagtgagctgacatcgcactactgcattcaagcctaggcgacagagcaagaatctgtctcaaaaaaaactgaaaaaacaaagagttgttcctgatgctgccgtgagattagcatcctcgccttctgctttgagggaaagatgtgagattttcagatcagatacaaagtaacaggaataggtaccatgaatgggaaccggcagccaagtgacagtgttgtgatgggtataggctgggctaggtactttacacaccttaaatttttgattcttagatgccagcataggtgaggtataacatttcagagtaagtcacgtctttctgaaacaacagaaacaaaaaaacgataaggccccgttaaataactggtccgtttagcactacctgcaatagcaaagatgtggaatcaacctaggtgcctattgacagtggattggataaagaaaatatggtacatatataccgtggaataccaccagctagcaaaaaaagtaaaactatggtctttgcagcaacatggatgcagctggaggccattatcctaagtgaactaatgcgtgttctcacttataagtagaagctaaacattgggtacaaatggacacaaaggtgggaacagcagacactggggactacaagagggaggaaggagggagggaagagttgaaacactacctgttaggtactttgctcattatctggctgatggtttcacccagaccccagatctcagcatcatgaaatacacccttgtaacaaacctgcacatgtacctccttagtctaaaataaaagttgaattttttttctttttctttaattttttttttttaagagagggagtctcgctctgtcgcccatgctggagtgcaatggtgtgatctcagctcaatgcaacctctgcctcccaggttcaagcgattctcctgcctcagcctgctgagtagctgggactacaggtgcacaccaacacacctggctaatttttgtatttttactagagacaagctttcaccatattggtcagactggtctcgaactcctgacttcaggtgatccacccatctcggcctcccaaagtgctgggattacaggcatgaaccactgcacccagcctactttatttttaatctccatctagtatttagactagagatgggcaaatttttcttttttgttttctttaaaatttttttttttttggtagagatggggtctcactatgttgcccaggctggtcttgaactcctggcctcaagtgatcttcctgccttgacctcccaaagtgctgggattacaggtgtgtgtcatcacacccagccctgatacactttttctgtacaaggatagatactattttagggtgtgcaggtcatatggcccctgttgcgaccactcagctctaccaccgtactccaaagctgtagcctaaagctgccatagacaggcacctaagtgaatggatgtggctatgttttgtttcagcttgattggtgagcactgaaatttgaattttatataactttcccatgtcataaaatattattattcttttgatgttttcccacagccatttgaaaatgtagaggtcatctcaaaaaagaaaaaaaaggaaaagaaaatgtagaagtcatccttagctcaagggccatagagaaactggcattggtctgggtttggtctgaaggctcatggatccctaccctagacaaataataggcatgtaaaaggtattcacatcacagctggctttttttttgaaacagagtcttgctctattgttcaggctggagttcagtggcatgatcttggctcactgcagcctccacctcctgggctcaagcaatcctcctgcctcagcctcccgagtagccgggattacaggcacaagccaccatgcctggctaattgttgtatttttagtagagatggggttttaccatgttgttgaggctgatctcgaactcctgggttcacaggattcatctgcctcagcctcccaaagtgctgggattacaggcatgacccaccacgcccggccatagctggctttttgcttgctgtgggaggagaaagttctggctgcttggcttcgatgctatgcttggctcttccaaccaccatttgtggctttttgctgccagagcttgtcatgctgctgcattgcccaagagaaaaagtttgtgaggttccacgttccatcatatcgatgatcattttagggttttcacacacaagagacaggattattgcaagcaacagcaatgaactttggaaaactcagaggttttccaagtgtgagatttaaagcctcatgcatgaaactttaaattagtttaagggggcgtaaccagcataaaaaaaatgaaatagaaggaaataggaaatagaaagctgcatctatgctgctaaagttaagtcttatttccgtgcaacctttcgtttgtttgttttgtttgttcgttttctgagacagagtctccctctctggagcgagtctcacccaggctggagtacagtggtgtgatctctgctactgcagtccctaccttccgtgttcaaacgattctcctgcctcagcctcttgagtagctgggaccacaggtgcatgccactatgcccagctaatttttagtagagatggggtttcactgtattgaccaagctggtctcaaactcctcacctcaagtgatccacccatctcagcctcccaaagtgctgagattacaggcatgagccaccatgcccggcctattttgtccaacgtttgttttacttatgcctatgtgtgtatgtacatactgggtcactcttagtatttcttttttttttttttttttttttttgagacaggagctcactctgttaccgaggccagagtgcagtggtgcaatcatggctcactgaagccttgaattcctgggcttaagcgattctcccacctcagtctcctgagaagctgggactacaggtgggtgtcaccacacccagctagctaactaatttttttttttttttttttttttgtagagacagggtcttactttagtgcccagactggtcttggactcctgggctcaagtgagcctcctgcctcagcctcccaaagtgctgggattagaggcatgagccactgcatctggctctctgagtatttcttactgtgatccacagtaagtaaacttatttaaataagtttgcaaagtacaggaacttaaggaaaaggaatgtatctggaaatccttccagaatttaaaacaaaaaatagctctaggcacagtggcttacgcctgaaatcctagcactttgggaggctgaggcgggaggattgctagaggcaagagtttgagaccagcctgggcaacacagggagatcccatctctacaaaacagttctaaaaattatccagtcatggggcgtgcacctgtagtcctagctacttgagaggctgaggcaggaggattgcttgaacccaggagtttgaggttacagtgagccatgattgggccactgcgctccagcctgggagacagagtgagaccctgtctcttaaaaaaaaaaaaagaaaagaaggaaggaagggagagagagggagggagggagagagagagagagagagagagaaagaaagaaaaagaaaaagctaaacagccagaccttagagagaagaggaaccttggtgactaggaatttccagatggcagaaaattccgggtactgtcatctggctgaatcagtcccactcttttgcatctctgagccactgtgcccaagattcaagtacctgggggagaacacagagaagatctctgcgttaaccagagtccatttctgttgcttgcaaatcatcccatctcctgtgtgtgcaaactcctaaaataagcacttttagaagaaacgctgactcgtacaaactttccctgtgtcctaaggcctcctgccagctttgcaactgctgctcgcgggcaagggaacctctccagtctcaggacaatggtggttgggagaagctaagctaaggtcaaagccaaacacagcgagaacttagcctaagtgtatcggaccagctaggatcaagacccaacccttgactaggaaggagggcatcttgaatgccagttccctaagacagcatttcacgggtgaggtgtattctcccatggcaagacattggaggtgctatcatgagagaaagaacaatggatgcttgcagaacagaacccgcagatgaccactaaggaatgacactggttttccttctctaataaaaataacaacaacaacaacaaaaatagctgggcgtggtggcaggtgcctgtaatcccagctactcgggaggctggggcaggagaatcacttgaatccgggagacggaggttgcagtgagctgagatcgcaccactgcacaactacctgggcaacagcacgagactctgtctcaaaaacaacaacaacaaagaaaaaaccaaaacaccgttgcttttattctgataataaaacagggttaatgctcgaaattttaaaactaaaaaaataccaaaagttataaaagagggcaaatgtcatttaaaggaatgctgcagcgaggtagagtctcacacctgtaatctgaggcagaaggcaggagcttgagcccaggagttcaaggccagcttggccaacacagcaagaccctgtctctacaaaaataaaaataattacctgggtgtggtggtgtacctctaattctattattagctacttgggaggccaaggcaggaggatcacttgactccaggagtatgaggctgcagtgagccaagactgtgccactgcactccagcctgggcaatagagtgagaccctgttctaaaactaaccggctgggcgaggtggctcacctgtaatcccagcattttgggaggccgaggcgggcagatcacttgaggtcaggagttcgagaccagcctggccaacgtggtgaaaccctgtctctactaaaaatacaaaaaaattagctaggtgtggtggcacgtgcctgtacacccagctacacgagaggctgaggctgaagaatcacttgaacctgggaggtggaggttgcaatgagtcgagatttcgccactgcactccagcttgggtgacagagctaactctgtctcaaaaataaaataaaataaagcaaaccaacagaatgccaccaacctccaataaccactgagagcatcccttcagatgtcccttcctcccttcccctttccttcctctcctcctcttcttcctgttctgagtcatgtttctcaaggagagacaagttgtactttgggatctggtctcttttctcacacatctctgctctctaggggggcacctccctccctatggatatcacagggagtttttttccttttagagtttgaatggaggaagacttcagacagaactgtacacagcacagagctgcagagaagtggaagattaagagaaaataatgttggacaaattagatgtagcttgtataatctggagctacagtcacgagaataggatgtaacataaagtctaatgtgattcagcaaacacacgttttcattacttttgtgcagatggctctgctaggtgacttggaagggaaggaaaccgaggcagtgttgcttccttcgaggaagacagagttgcttcctttccccccatccactggggacagaatttcaaagagattacagcacagaccagcctgtggcaaatgcatgagccaagtgtgatggggacacagaggcgattaaaatgcaatcattagggctggtcatggtggctcacgcctgtaatcccagcactttgggaggccaaggcgggtggatcacttgaggtcagcagttcgagaccagcctggccaacatggtgaaaccccatctctactaaaaatacaaaaattagccggtgtgatggcacatgcttttagtcacagctactcaggaggctgaggcaggagaatcgcttgaacccagaaggcggaggttgcagtgagccaagattgtgccactgcactccagcctggatgacagagtgagactcagtctaaaaaaaaaaaaaagattgctgttctatttatgctgtgaacattgctgaaagattgagcaggaaaaatggagatcaatgctcagtaagttccacctgaaagacctcctttgaacatagcaactgttcacttggtgaaatttggctatacaggtaatgaatactttgtgagaaatcacactctgtggtctccgagtagcattaacaatctcttgcaacagagaaagctgaaatgaagaggagaagtgtagaaaatgtcatctgagggcgcgcgtggtggctcatgcctgtaatcccagcactttagaaggcagaggcaggtgacctgaggtcaggagttcagcctggctaacatggcaaaaccgtctctactaaagatacagacattagccgggcgtggtggcgtgcacctataatcccagctactcaggaggctgaggcaggagaatcacttgaacccgggagatggaggttgcagtgagccgagatggcgcaactgcactccagcctgggcaacaaatggagactctgtctcaaaaaaaaaaaaaagaaaagaaaagaaaatgtcatacccaacagtgtgttgggtatgacaactactagtgtgtccagccatcctggtttgcctgggactatcctatttttagctctgaaaagtctttttaaaattttatttatttatttatttttgagatggagtctcgctctgttgcccaggctggagtgcagtggcatgatcttggctcactgcaagctccgcctcacgggttcacgccattttcctgcctcagcctcccaagcagatgggattacaggcatgtgccgccacacctggataattttgtatttttttagtagagacagggtttctccatgttggtcaggctggtctcaaactcccaacctcaggtgatccaccagcctcagcctcccaaagtgctgggattacaggcatgagccaccgcgcctggccatgttaactatatattaagatacgaaacagctttctttcaaggggtgcagctttaaaacagtctacagtagcaaggcatttaacctgtactcggaagccaggaaaccttggcctgacttgccactgtgttctttgaaaggtccgtcgttaatgtttgactattcttaatgacaatttgtggcttatcaggttgacgttttcctttcttttcaggcagctgagacttaagggagtgaagtaatttggtggtattcattgcaggggccacatagatactgtcagtacgcttttaaaaatctttttaaagtaatagatgctcattataaaaattcaaacaatacaaaagtgtagaaagtagaaagtactttctacttcaggaagaaaatttcccaccctcaaattgtcattccgtcacaagtttgatgtgtatcttctcagtgttttgttggacatatgttaacacatggattttaaaaaatgaattggatgatatgtgtactaatcagtcttctttttttattcaaactatatatcatgaccatctttctaagtcagtaatacagcattatcttttccttgttttttttttttttgagagaaagtctagttctgtcacccaggctggagtgcagtggtataatcatagctcactgcaacctctgcctcccaggttcaagtgattctcatgcctcagtcacaggagtagctgggactacaggcacatgccaccacacccagctactttttgtattttttagtagagactgggttttgccatgttatccaggctggtttcgaactactggcctcaagtgatctgcctgcctcagcctcccaaaatgctgggaagacactgcatcagccaaaaaaagtatcttgtgtttaatttggcctatgtcttccttttctgatcactgcataatttttcagtgtctggttataccttattttttcttaattaattctttattgatggacagctaggtgatttaacaatttgataaagaatgctgcaataaatatcttttgtcatttttgcacattgtccaattatttcctctatataaattcactttttttttgatgcggaatctcactctttcgcccaggttggagtgcaatggcgcaatctcggctcactacaacctccacctcctgggttcaagcaattctcgtgtctcagcctcccgagtacctgggattacaggcacgcgccactatgcctggctaatttttgtatttttagtagagacagggtttcaccatgttggccaggctggtttcgaactcctgacctcaagttatccacccaccttggcctcccaaaatgctgggattgtaggcatgaggcactgtgcccagcctcctctatacaaataattaaaagtagaattgctgagttaaaagctttcaactaggtttagaatgtggaagatacacaaatctgaattcactttatggggtgcatatttgagactaaattaaaactaattaacttgaggaagaaagaaaatatcgtaattcaaatgatactgtggaaaaagtagcagagtaggagttagaatactttggttctagagcttgttcaccttccagctaactggttgacctttgacaagcttcttaacctttttgcacgtctgactcttgcctccagttgtatctggtctcatgaatcttccaaataattgacagagtcattttctacaatgcgaatatgacctctgcttaagtccatcaggagctcaccattgcctttggggtgaagctaaaactcctagctaaccatgcagcagtctgtgtttgtagcttcctctccctccacgtgcccagccaggacctttgatccacctgttctcacctcctttcattgccttcaatgctcacagtttgctaagcctccagatgttggttcaggttgttccctccttctggaatatctggtcccttctctgaccagctgacttctactcattcttcaagaaatagcttggactttgtattagtccattctcacgctgctataaagaaatacccaagattgggtaatttataaaggaaagaggtttaattgactcacagttccgcatggctggggaggcctcaggaaactaataatcatggtggaagagaaagcaaacatatccttcttcacagggcagtagaagagaaagaacgagcaagaacagggaaaactgccttaattaaccatcaggtctctcgagaattcactcactatcacgagaacagcatagggaaaaccacctccatgatccaatcacttcccactaggtctctccctcaacacctggggattacaattcaagatgagatttgggtggggacacaaagcctaaccatatcagacttcttaccttctcagaagactttcctgacacctacaggttgaactgatgcctcttctcttggcttttgtgaaggcagcatattactttacacatcctctgtaaatagcacacactgtattacaacggctgactttcttatctgggtcacttcattcttttgagggcagaaaccgtgacctgttcatctttgaatttatagtatctaccacagtgtctgacacatacagatgtttgctgaatctttgtggaataaaacaattgatctataaaataagtgattggattcagtaatacaaaattgcagccaagtatggtggctcacacttgtaaccccagcactttgggaggctgaggtgggtggattacctgaactcaggagtttgagacgagcctgggcaacatggtgaaaccccatctctataaacaatatgaaaaaattagctgagtatggtggtgcacacctgtagttccagctacttggggggctgatgcaggaggattgtttgagcccagaaggtcaagactgcagtgagctgtgttggcaccactgcactccagcctgggcaacaaagtgagaccgtgtgtccaaaaaaaaaaaaaaaaagtagaagtttatgagaattaaaagttcaaggaaacctcagaactactaaggaaacatctcaaaataatacagtaaaaaaaacacaaacaaagccaggtgcggtggctcacgcctgtaatcccagcactttgggaggctgaggcgcgtggatcacgaggtcaggagtttgagaccagcctggccagcatagtgaaaccccatccctactaaaaatacaaaaaaattatccgggcgtggtggcgggcgcccataatcccagctactcgggagggtgaggcaaggagaattgcttgaacctgggaggtggaggttgcagtgagccaagatcgcgccactgcactccagcccaggtaacagtgtgagactctgtctcaagaaacaaacaaacaaacaaaacacacacacaaacaaacaaaggaattaaaatggcacactggaaaataacatgaaagaaagctattaaaaaggaacagactaacaaaaaagacatgaaggatataaaaaacaaatagcaaaatgtcaggtgtaaatccaaccacatcaataattacataaatgcaaatggattaaatactccaatcaacaggcaaagatcgtcagactggattaaaaaaaaaaaaacaccaggatccaactatgtattgtctataagagacacacttcagattcaaagacacaaataggttgaaaagaaaaggatggaaaaatgtatagcctgcaagcataagagagcaggagtggctatattaatatcagacagaagaaaatttaagacaaaaaatgttactagagacaaagagggacattttatagtgataaaaacaacaatacaacaattatatatgtgtccaataacaagagtagaagggaattgtagaatgaattatagaacctttacagtgtgaatattgtaacttacagtgtgtaaattacagtgtgttttcagaaccataccttggaacctctccagattctttaccttgtggcctcctgtccactccattctaaggtgttatcatactgaagtgcaccatagtggtggtcttgatggggaaaagaaatcacagtagcactaacaggaaacatcctgagggaagaggcactgtcatttttaggtgtagggaagatgtttaagagcccgttttaaacatctgagcttctggtctttggaattttgtcagcccagagacagtttcttttcttctcaattctcttttcctttaattggtcttcttcttgccatacctcattccttagtcatcctggtcttgatctcagaaatctcacattctcattgatttagcatggttttctactctagtgccagttctactgttggatggaaagaaccatcttctgatgtgacaggaagccttaattattaatttaaaattcccctacccttctccaacttctatggaagttaactcaggaattattggagtaggttgaagattctctgagtgggaggatgggtgagattcaaattagagaagtactatgaggactaaatgaccctacctaagaaagacagtttccaaactaaagttatgggagttgggtacgtaggtagggactcgggaaccatcttggctagagaagggtcagaggaaaaatacagaggaaattcatgggagagagtatcagggtggatatatacggaacagatgcatacttcaaggggacatttagacattttgctctgggatgagcaaaatcaccctctttttcatctcccaacaaaccatttaataaaaagtaagacattactcattatcggagcaggatctgttgatttcgttttttaatttttttaattcatttgtgtttgatgtgatgatgtgccaagaccagcctgaaggtggccaagggcaaaagcagaggttgttatttgcaggctacgttgacactaggtagtgaacttcacagctcaacacatccacacatattggctgaacgttaattagttctgcctagttacagggtttccaaaatggatgagacattctgcctcccctcaaggaatttgtgggctggtaaaggagacagacacagtaacagatcattatgtaatatgctaagtgctttatcagaggaaaaaagctgggtgcaggctgggcgcagtggctcacacctgtagtcccagcactttgagaggccaaggcaagcacctgaggtcaggagtttgagaccagcctggccaatatggtgaagcccattttctactaaaaatacaaaaaattaaccaggagtggtggcacatgccggtagtcccagctactcgggaggctgaggcaggaggatcgcttgaacccaggaggcagaggttgcagtgagccaagattgcaccagtgcactccagcctgggtgatagagcaagactctgtctcaaaaaaaaaaaaaaagaagctaggcgcatcaggggctttgagccttctgacccagcctgggaacagggagaagcacaattcaaggggacatttagacattttgctgtgggaggagcaaaatcactcctggcaggagcgacccccgggctcagttcaccaggtgaaaggaacaggcaaagtcacataagtacaaagcagtgtggtgcttcctgggaccaaaaagcaattcgttatcaataaaacatactttgcgttggttcccatcttaccgaaccttctttcctttcttctttcttccctgcttccttctcacacgccctccactcacctctcagaactcattctatgtgatctctacccaaagcacagtgctaagagcccggaataaaacgggcaaaaccaacctagccattgtcctcatagaattaatcatacaaataaaaatataattttaacctgtggcaagtgctcagacagaaaaaatccagttaggctgccagtaaaaatactagatgtggccggatgtggtagctcatgcctgtaatcccagcagtttgggaggacaaggcaggtggattgcttgaacccaggagtttgagaccagcctgggcaacacagcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaacaggaagaccctgtttcaccaaaacaacaacaacaacaacaacagcagcagcaacaacaaacaaaaaactcccccaaacaggtgcccagttaactttgaatgtcagataaacaacatatatgattttgcagtataagcatgtcccatgcaatatttgggacatacttatcctacacaaaaattgttttttctgtgaaattcaaagttaactggatgtcctgccttttttttttttttttttttttttttttttttgaggtggagcgtcgcactgttgctcaggctggagtgcaatggcgccatcttggctcactgcagcctccacctcccaggtttactagattctccagcctcagccccctgagaagctgggattacaggtgcccaccaccacgcctggctaatttttttgtatttttagtagggacagggtttcactatgttggccaggctggtcttgaagtcctgaccttgtgatccgcccgccttggcctcccaaagtgctgggattacaggtgtgagccaccacacctggcctgcatttttatttgtaaacctggcagccttaagtccaagatcccatgagctcacatgactaggggacctgagttaacctgggctgcagtgggagaaggtgattggagaaagcctgacatctgcagaacagggagctgcacctgggagaggaggccggagaggggagtgacctggagaagggaacagcctgaatgcgaacagaaattggccccaacagagcgttcaagagtctgagagaaggctcctggggcttgagcacagacatttagtttactgggatatggagagaggagaagcaattggaaaatgagtaaatatatcatgcttttaaggaggcatgctgtacaagtaaatgtcaggtacagtgactcaggttattgatttgaaagattagtcagtggagacatgtgctggacttactcagtccctctgttgtcaaggaagtccaacgccaccagcactagatccttcaacaatgcagagtcctcccgcaaatgaatctgactttgcctgtaaaccgcggagagtttcaaaaactggaaagcattacaggtggccagtttgtttccatttatataaagtgcagcaaaaatgatctgtcagagagagaacattgggataaatttcttttttttttttttcttctggagacaaggtcttgctgttgcccaggcaggagtgcagtggtgcgaccatggctccctgcagctttgaactcttcatcttaagggatcctctcacctcagcctcctgagtagctggggccacaggtgtgcactagtatgtctggccaattaaatcaattaaatatatatatattttgtagaggcggggatctcactatgttactcaggttggtcttgaactcttggtcccaggcaatcctcctgctttggcctcccaaagccctgggattgcaggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatattttcagtgtagccttaacaatgaatcgtagtaacttctcaccttacatgctccccaaaagatgtcactttgggagaacatattcaaggaaccctccccaatcctgacccccatccccaccccagctcctgctgctgttgacacaactgccttagctgtgaggctgtgccatccattggaacctgggactttccaatgttgggatgcctcagcatcatcaagcaaaattggggttctttttgtgtatgctttaaaaaaaaaaaaaaaacttgaagcataaaactattactggaaagtggtcctgatccagactgcaagagagggctctcggatcttgtgcaagaagaaatttggggcaactccatagagtaaagtgaaagtagtttattagagaagtaaagaatcaaggccgcgcacagtggctcatgcctgtaatctcagcagtttgggaggccgaggcgggcagatcacctgaggtcaggagttcgagaccagcctggccaacatggcaaaaccccatctctactaaaaatacaaaaattagccaggtgtggtggtgggcgactgtaatctcagctactcaggagactgaggcaggagaatcacctgaacctaggaggctgaggttgcagtgagctgagattggtccactgcacttcagtctgggcgacagagtgagacttcatcttaaaaaaaaaaaaaaaaaaaaggattccaaagaatgtcaggtatggtggctcatacctcccagctctttgggaggccaaggcgggaggattggttgaggccaggagttcaagactacactggccaacatagagagaccctgtctctaattttttaaaaaagaagaaactaaaaaaatggcttctctgtaggcagagcagtctcgagtgctgctggttgacaattcttgtggttatgtcttgatcgtatggtaaacaagaggtggattattcatgagttttccggaaatggcacagggaattcctgaaactgagaattcctcttccttttagactatattgggtaacttccagaagttgccatggcacttgtaaactgtcatagtgctggtgggagtgtcttttagcatgctaatgcatcataattagtgtataatgagcagtgaggatgaccagtggtcacttctgacaccatcttggattgggcaggttttggccagcttctttattgcaccctgttttatcagtggggtctttgtgacctgtatcttgtgacctcctgtctcatcctgggactaagaatgcctgacttcctggggttgcagccaagtaggtctcagccttattttacccttattcaagatggagtcactctggttcaaatgcctctgacaaagccagcatagatgaagacctaacacccttgagcaaatgaaagatctgtgtgatggaacagttgcgtgtcttgattggggtggttggttacctgaatctgtacatgtgataaaattgcacagaaccacacacacacatacacacacacaccaatgaattggatgtaaaactggtgaaatctgaataaggtcagttatgcaaaatgtcatcactggggaacattgggtgaaggttttttaggacctctctgacatacaaacggatataaatcagcaattctctccaaataaaaagctaaacaacaaaaccgaccccaaacactgacaccttgtatccatcatccaaatttggtcaatgctaagatatatatttttttttttttttttgagactgggtctcaatgtgtcacccaggctggagtgcagtggtatgatctcggcttactgcaaactctgcctcctgggttcaagcgattctcatgcctcagcctcccaagtagctgggattacaggcacccaccaccattccaggccaatttttgtatttttagtagagacagggtttcaccacgttggccaggctggtctcaaactcctgacctcaggtgatccgcctgccttggcctcccaaagtgctggtattacagctgtgacccaccgcacccagccctaagatctttgtattagtcctttttagaaaaataaaacaaaaccttaaagattcagctggagactcctactcagtcctttttctttccagaaatgacccttgtcatggaattaatatgtatttatcttttccacatttgcttttactgtattatgtgcatagtcataaacaatctgtgatatcctgttatacatttcctttggtagcttattttgccactaaacatgttttcaggatttatgcatgttgaaacatgtagatcaattcttttaattttttaactgctcaaagtatttctaataggtgaatataccacaaattcttcaaccaatcttccactgataataggttgttttccatttttcagtattaccagacattgctatcatggccatccaggtataaatgcctttttgggtcaagagtttctgcagggtttttatctagaattgaaagtgctaagcagacagtatgcacatactaaacttcagtaaacattgagaaattgctatccaactgtgactctataaatttatggctgtcccagcaggtggtaataatcaccatttccttatattttcaccagccaacctgatctttccagactgttaaaagtttgccaatctgatggatgtaaagtagtatttcattgttattttattattgtgttttcctgatttccaatgaggttagacatctcttcataggtttattagctggaatttcctcttctgtgaatcctgaggtcgtacccttttgccctttttttttctattgtgttgtcattgtcataggtattttttgtattttgttcccgattgttttgtatgtttgtgtattataaatttcagcttgtggcctgtcttttaaaaaaagactttttattttgagattattgtagtttgcgtgcagttgtaagaaataatacagagatctatgtatgcctttcacccattttaccccaatggtgacattttggacagctaaatacagtatcaaagacaggaaattgacattgatacaatccattcatcctattcagatttcaccagatttatgtgtgtgtctgtgtgtgtgtgtgtgtgtatttagttctatacaattttatcatatatttagatttgtgtgactatcaacaaagtcaagatacagaacagttccatcacaaaggttcctcctgctacttttgtatagttacagttaccttgccccattcaacccctagcaacaacaattagttttctatttccataattttgtcatttcaagaatattaaagaaatggaatcatgcagtatataacctttttgagattggctttttcactcaccgtaattctctcaagatccatccaagttgctgtgtgtatcagccattcattccttttcattgccaagtaatattccattgtatggatgtaccatggtttgttttacccattgaaggacatctggattatttccagttacaggctattatgcttaatgctgctatgaatactcttatgcaaatttttgtgtgaacataagttttcatttctctgagataaacgctcaggagtgcagttactgagttgcttcaaatgcatatttagccttataagaaattgccaaactattttctagagtggttgtaccatgttacattcccattggcagtgcacaagggattcagtttcttcccatcctcacctgcatttggtgttatcattattttttattttagctagtctgataggtgtgcagtgacatcttgtggttttaatttgcattttctttatatctaatgctgttgcacatctttttatgggcttatttgtatgtccatctgtataatctcttcagtgaaatgcctgttcatgtcctttgtccacttactaattggtttatttggggtttttctgctgttgacttttaagagttctttatgtattctaaatacaggtccttgttgggtatgtggtttgcaaatatttcctcctagtccgtagcttgttttttcactttcttgtcaatgaagagtcaaactctgtaaaatatttgaagatacttattctgagccaaatggaagtgaataatgacctgtgacacagccctcaggagatcctgagaacatatgctcaaggtggttgggccacagcttggttttaaacattttagggagatacaaggcatcaaccaatatatgtaagatgtacattgatttggtccagaaaggcaggacaactggaagcaggaactttcaagtcataggtggattcaaagattttctgactggcaattgattgaaggagttaagttattgtctacagactgagaatcaatagaaaggaatgtctgggttaagataaggggttgtggagaccaaggtttcattctgcagtcaaagcctctgtgtagcaggattcagagagaacagattgtaaatatttcttttctttttttttactttttcttttcttttctttctttctttcttcttcttttttttttttttttttttttttttttgaggcagggtctcagtctgtcaccaagtctggagtgcagtggcacgatcacagctcactacaaactttgtctccagggctcaagtgatcctcccacctcaaccttccaagtaactgggactataggtgtgcacctccccacctggctaatttttgtattttttgtagagatggggtttggctgtgttggacagactggtctcaaactcctggcctcaagtgatccacccacttgtcttcccaaagtgctgggattacaggcatgagccaccacacctgacctgattgtaaatgtttcaatcagacttaaagagtctgttctattaataattccaaaaggaaggcaggtataatgaggcatgtctggctctcccttccaatcatggtctgaatgactttttcaggttaactttgacatgcccttggctgagaggagggctccattcagatggttggggggccttagaattttgtttttggtttatactcttcacagactcttttgcagagcaaaggtttttaattttgatgaggtctaatttatcaattttcccttttatagattatgctttggtgtcaaatctgggaactctttgcccccctttaggttcttaagattttcccttgttttgttctgaaagtattatagttttacattttacactaagtctgtgaatcattttattttttgtgtaaagcatgataattaggtagagatttatttttttggcctgtggatatccaatttgtccagtattgtttgttgaaaaggcttgacttcctccaataaatcatcttcacacttttttttttttttttttttgagacagatccttgctgtgttgcccaggctggagtccggtggtgcagtcacagctcactgcaacctccacctcctgggttcaagtgattcttgtgtctcagctaagtagctgggactacaagtgcgtgccaccacacctggctaacttttgtatttttttagtagagacagggtttcaccatgctggccgggctggtcttgaactcctggactcaagcaatcctcccacctcagcatcccaaagtgctgggattacaggcatgagccactgcacccacccttcgcacctttgtgaaaaataatgtgggcacatttgtttggggctatttctggattctctgttctgttccctcaatctatatgtgtattcttccaccagtaacacagtaacacagtcttgttaaagtaagctgtaggtatatgtaatcatttgtgattccttccagcttattcatatttctcaaattattttagctcttacaggtcctatgcctttatatataaaatttagagtaatatcgtttatgtcttcaaaaattaccttgcaggggtattgataggaatagcattaaacctacaggtcattttgagtgtaactgatatctttactatgtggagtttgccaatccatgaacacaatatgtctcccgatttattgagatattcttaattctttcttcagaattctgtaaatttcagcatacatatcctctacatattttgataaatttatatttaggtatttcattttctttggagtaattataaatggtaatgtgtctttaattttggtttccacatgttaattattagtatatatagatgcagttcatatttgtctcttgacattggatcttgcaaactttctaaactcttgtattagctctaatagttttttggtaagttattggagatctacgtagacacttaagtcatctgcaaatagggacagttttatttcttccttcctaatttgtatgccttttatttctttttcttgttttattgcactggctagaacttcagtactatattgaatgacagtagtgagagcagacattcttggctttttcccaattttagggagaaaaaaatcaggttctcaccattaggatgttagctgtagttttgtgtagatacactttattaagttgagaatgttctcccttattcctactttctgagactttttgtactacatgagtgttggattttgtcaaatgctttttctgcatcaattgatacaattgtatgattttttatttttaccttgttaatatagtggatcacacattgattgattttcaaactagctttgcatacctggattgtcccacttagttgtggtgtataattcttttcatccatcattgggtttgatttgctagtatttttagtattttgttgaaaatttttgctctaagttcatgaggaatatattggtctgtagttttcctttgttgtactgtctctctctggttgtggtatgacggtaatacaagattcataaaatgagtgatggagtgttcctttttctttctttctttcttttttttttttagacagagtctttctctgtcgcaaggctggagtgcagtggcgcgatctcagctcactgcaacctccaactctcaggttcaagcgattcccctgcctcagactcccaggtagctgggattacaggcacatgccaccacgcctggctaattttttgtattttagtagagacggggtttcaccatgttggccaagatgatctcaatctcctgacctcatgatctgcccactttggcctcccaaagtgctgggattataggcatgagccaccgcacctggcctcttttttttttttttttttttttttttttggagagggagtcttgctttgtcactcaggctgcagtgcagtggtgcaatctcggctcactgcaacctctccctcccaggttcaagtgcttctcctgcctcagactcccgagaaactgggactacaggcgcctgctgccacgcccagctaattttttgtattttagtagagatggggtttcacgatgttgcccaagctagtcttgaactcctgacctcaagtcatcctcctgcctcggcctcccaaagtgctaggattacaggcgtcagccactgtgcctggccaagtgttaccttttctattttccacaaaagattgtgtaaaatatgtattaattctttaaagatttgatagaattcttcaatgaagaattgatagagattcattttttttggcctatggatgtccaatttgtccagcgttgtttgttaaaaaggaataatttgaaagctcacaaagagaaatatccaggcaatttctggagatttctcctggagatttctcttttgggagtttttaaattatgcactcattttccttaatggttttagaactatgcagattttctaattcgtcttggatgagtttggtagagtgttgtttttgaggaattggtccatttcattaagttgtcaagtttctgcgtaaaaagttgtttgcagtattcccttgttatctactcagtggctatagaatctgtagagattatcacctgtttcatttctgatattagtgctttgtgtcctctctctcactctctctctctgtctgtctctttttagagataggggtcttgctgcattacctaggtgagacttgacctcctgggctcaagagatcctcctgtctcagcctccaaagtagctggaactacaagcatgcaccaccacgcctggctaattttttgtagagatggggtcttgctatgttcccctggctggtctcgaacttctggactcaagcaattctcccacctcagcctcccaaagtgctaggattaaaggcatgagccactgcacccagccctctttcttcatataagcatttagtgctattaattttacactgagtacagtctctgtatcacatatgttttgatatgttgtattttcattttcatttggttctattctttaagttttgttttagaattcttctttgacctagagattatttagaagtatgttgtttaatttccaagtgtcaggagattttctgttatatttctgttattgatttctggttttgttccattatggtcagggaatataacacataattttaattcttttgaatttgttggggattgttttttggccggggtatggtctatcttggtaaatgctctgtgaacacttggaaaaaaatatgtattccactgttgttgggtgaagtgttcccaacttaaatatcaattaagttgaatgttatgcagttattctatatccttgctgattttctgtctagtaagtctaccagttgctcacagtgggatgttgaagtgatcaattgtaactgtagatttgtgtacttctcctttcggctttatgaatctttgtttcatgcatcttcagactctctgttgtttggtgcatacacaggattgctatgtcttcttgataggttgacccttttatcatgatgtaatgtctctctggtaattttctttgctttaaagtctactttatctggtattagtagagccatcctggcttttcttttgattaacatttgtgtatctttttctatcattttactttgaatctgcctatatcattatatttgaagtgagtttcttctagataacatattgctggataatgttttcatgttcattttgccaatctgtctttaaactgatatatttagaccatttacatttaaggcaattattaatgtgttaggatttaagtctgccattttattgtttgtttctcctgtttttccttctctgcttctcttttcctactttcctacaggttacttgacatattttaaggattccatctttttttttttttttttgacatggtctcgctctgttgcccaggctggagtgcagtggcatgatgacttggctcactgcaacctttactttccaggttcaagcagttctcatgcctcagcctcccaagtagctgagatcacaggcatgcgtcactatgcctagctaatttttgtattttcagtagagatgaggtttcgccatgttggccaggctggtctcaaactcctgacctcaggtcatccacctgcctcagcctcccgaagtgttgggattacaggcgtgagccactgaggccagccagattccatctttaaaaaaaattattattgatttttgtgggtacataagtacccaaataagataaaactaaagttccaagccttcttctgttatcattacctttctgtttggagaatttcctttagcctttttttttttttttgagttgtagctttgctcttgttgcccaggctggagtggagtgcagtggtgccacctcagctcactgcaacctcgacctcccaggttcaagtgcttctcatgtctcagcctcctgagtagctgggattatataggctcctgccaccatgcccagctaatttttgtatttttagtagcgatggggtttcattatgttggccaggctggtctcgaatgcccgacctcaggtgatccacccgcctcagcctcccaaagtgctgggattacaggtgtgagccaccgtgcctggcccctttagccattctttaagggcaggtttactaacaacaaattctcttagtgttttctcgcctgagaatgtctttgtttcctcttcattcctgacatctatttttgccagatatagaattcacaattcataattcttttcttttacttcttgaaaaatattgagtcacttccttctagttgccatggtttcaaaggagaacttgactgtcatttaaattgatgttccctttcaaataatgttttatggctgggtgcggtggctcacgcctgtaatcccagcactttgggaggccgaggcaggcggatcatgaggtcaggagatcgagaccatcctggctaacatggtgaaaccccgtctctactgaaaatacaaaaaaattagccgggcgtggtggcaggtgcctatagtcccagctcctcgggaggctgaggcaggagaatggcgtgaacccaggaggtggagcttgcagtgagcagagatcatgccactgcactccagcctcggtgacagagtgagactctgtctcaaaaaaaaaaaaaaaaaagttttatttctttctgaatccattcaagatttttcttttttttttgtcagagtttaaggacatgtcttggtatggatttctttagttttatcttatttgggattttctcagcttcttgaatccataggttatctttcttcaaatttgggaagttttcagctattgattcttcaaataatttttcagtaccatattctttcttttctccttctaggaatacaaattaatttttatttatttattttgagacagggtctcactctgttgcccagggtggagcgcagtggcacaatcatagcccactgcagcctcaacctcctgggctcaagtgatctgcctgcctcagcctcctgaattgagttgctagaactacaggcatgtgccaccacactctgctaaatttttttgtgtgtgtgtgctttttgtagagacagggtctcactatgttgctctgctgatcttgaactcctggcctcaaacgttcctcctgcctcagcctcctaaagcactgggatttcagtcatgagccactgtgcctggcctttctcttttttattcttattttttttgagatggagtcttgctctattgcccaggctggagtgcaatggtatgatctcagctcactgcaacctctgcctccggtgttcaagcgattctcctgcctcagcctccctagtagctgggatacaggcatgcaccaccacgtccagctaatttttgggttttaagtagagatggggtttcaacatgttggccaggctggtcttgaactcctgacctcaagtgatctacccgcttggcctcccaaagcactgggatttcaggtgtgagccaccgcacccagcctttctcttttctttttaagcaggtagccttcctgttgagctatagtatgaggggtggttgggatgtatattcactttcccccttggtgctggggccactttcctagaaaatatgaggaacaaacctgacagtgctgcattgcttcctggtagggggtgtacgtttagttccttactgcgctctactgctgctggggagtgagaaatgatgagttgactcgtaccactttgttgatgcagggtgagggcagaaacttagctccccaatgggtcccactgacaccagcaggtgggggagtgaggcaggagtacagactagccttgcacaaagtcagaggacagtccaaaagaccactctcacttctgacaccagctgcgagtttgggggtccccaaaactgtcctcaactttcatgctttgctagagggactcacagaactccctgaaagctgttgtactcacagttacagtttattacagggaaagagttcagattaaaatcaggcaagggaagaagcctggagggcagaatacaggtaagttctgaacacagagatgacagtggagtaatgggcagctttaattgtcctggcaataacatgtgacaaaatgaatggagtatgtcaaccagggaagctcactcaagccttggtgtcactgctagaccttcctgatacttgtttggtaaagaaatcagagtgccacctccttccactgggtgggggatggagaatcagctctcaatttgttcccacccatgctaccccagcaggggaatcagactgttaccacctgcttctgccacatgggagttggaaaatcaactttaatctcctgtcaatgatgtgtgaaaatacacacaaagtattgccaagcagggaagctctcccaagccttggtgtccagagtttttattggggctcagtcatgtagacctggttgactgcccacattgctgacctcattctccagcccctctgaaggtggagctgatgccatgtgacccaaagctcccatcctgaatcacatcacttgactttctgatgtggtctaaagcccccctgtgaacaaacacacttttattaagcaggacattccaaaggctgagagatgacctcccaggagctgaagtttaaattcattactgcatatcctactttgtacatgtcattcacttttttttttttttttttttgagatggagtctcactctgttgcccaagctggagtgcagtggcgtgatcttggcttattgcagcctccgcctcccgggttcaagtgattctcctgcctcagccttctgagtagctggggttactggcgcccaccaccatacccggctaatttttgtagtttcagtagagacagggtttcaccatgttggccaggctggtctcgaactccttacctcaggcaattcacccacctcagcctcccaaagtgctgggattacaggcgtgagcccctgtgcccagcccacatctcattcacttttattgctgccaggtgggtgtggaggttcagcttcacagtgagctttgttgacaccagtgtaggtggaaaatgcaggcctggctggccatgacttgtgccacttgtccaatcttggtgatgctgattgggatggagactccggctctgccgggctctgccaacaccagggtgagaaggaaagaagagtcatggtgagtagcctcaccttgcaccagctcattaagtctgctgaaggggaggggagagagacgggagacccatcaccagaccctgatgacatggctgtggcaggaaaatcagggtaccaccttcttccactgggtgggggatacaggatcagcttcccactcattcccatctatgtaccccagcaggggaatcagagcatcaccacctgcttctgccatgtggaagctacaagaccagatccccagttggccctgctgaaatgacagggaaggggttgcagtttttccatcagtctttggctggcagggcagatatggttaaaaaaaatttctctataatctcagcattttgagagtccaacgtgggaggattgcttgaggctagtagttcaagaccagcctaggcaactgtattagtctgttctcatgctgctatgaagaaatacctgagactgggtaattataaagaaaagaggttcagttgactcacccttccacatgtctggggaggcctcaggaaacttagaattgtgtgtggaaggcacctcttcatagggcggcaggagagagaatgagtgcaagcaggggaaatgccagacacttataaaaccatcagatctcatgagactcactcattatcacgagaacagcatgggggaaaccacctccatgattcagttacctccacctggtcccgcccttgacacgtggggattatgggaattacaattcaaggtgagatttgggtggggacacagagccaaaccatatcagcaacatagtgagacctcctgctctacaaaaaatacaataattagccagttgtgttgatgcacacctgtagtcccagctgctcaggaggttgaggcaagaggattacttgagcctgggaggttgaggctgcagtgagccatgatcgtgtcactccactccagcctaggcaacaaagtgagatcatggcttaaaaacaaaaatgaataaaaaatcctgttgctggttttctttcttttcttttgattcaggggaactggcttttcttagagcgtttttttttttctgtgcttggtagtggttccaggtcagaggcttttcctttactgtgtctgggatgttggggtatatggaagacaataagaaaactcaggctgctcactgccacgagtgcccaaagtcccaggatccagaggtagtatgtcttctccttttcacctttcagaatctccttatgcttgtctgctgtgttatgtctgtgagttatcagttgtaagagagaggacctgggaagaatgacactactgcatcttggccagaaccagaagtcctgtagcttgactttcactttgcttatgatactgtatttagttttgacttttaatgagtcaaatgcattgaccttttcctctaaggtttgtgtgtgtgtgtctgtgtgtgtgtctgtttaagaaatccttctcgacattcaagtcataaagatagctcagactttttctctagtttttaattttttttagatggagtctcactctgttgcccaggctggagtgcagtggcacaatctcggctcactgcagcctctgcctctcccgggttcaagcgattctcctgcctcagcctcccaagtagctgggatttacaggcacacaccaccatgcccagctaatttttgtatttttagtagagacagggtttcaccatgttggccaagctggtctcgaactcctgacctcaagtgatcctcccacctcagcctcccaaagtgttgggattacagatgtgagccaccacgcctggcctttttctctagttttaaagtgctttccccactcccatatttaggtatttagtctaattggaatttatttttgggtgtgacagtgattttcaaagcatgatccaaggaccctgggtgactgagactctgtcaggaggacgatgaggtcaaactattttcctaatgatgccaagatgtaatttttctttattgtgttgacattcccaatgacagtgccaaagcattggtgggtaacactttttgcaccttagcacaagaaggcagggcaccccactctactcatcttcatattcttcatggccatgtattcacagttaaacaaacatgcaccagtttcatttaagaatgttcttgatgaagcagtgagagttattattgttactgactcctgatcccaagtatgtctttgagctcttctggatgatggaatgggaaatacacgaaaagcacttcttctggattctgaagcacaatggttgtctcaaggaaaagcacttatgcagtggctggaactgaactagctgccttttgtcttttgttttttgtttgcgtagaacatcattgaaagaaatactgagaaactctgatttttcagccttgggtatttgtcagacattctctcaaaaatgagtaaataagcctgtcacttcaaggaaaacaactgacagtgtttgttgctggtgatcaaacttgagctttcaaataaacaattagaattctggaacacttgtatctgttaccatgggcttgatggtttccaatagaagactttttgatgtgattggtcgtaatgttaatgaatgtgattttggggatgaaatgtgtcaaatgtggaagatcagtgtaaatcagtggcctaatgttttgtaaatgaccaatacatgatattccaaaatcatacttgagcaaaagatctttcaaagagtaagatagaccaatgaattctcatgtaacagagtatgaattgatacagtttcagattccacattgcaagtaaaccttaaaaatgactacttcttgagtttgggtgtcatagaaaataagaatattcacaataatctgaaaaggctattaaactactcctgcctttgctaaccacacatttctgtgaggttagattttccttatatactccaaccaaaacaatatatattaaaacagaccgaacatagaagcagatataagaatctagccagacattgaaacgatttgcaaaaatttaaaacaatgtcactaaaaattttttgttttgaaaaatagaagattttaaaattaaataacatgttacctatgttaccatgtaatgaatttatagtgaatttaaaaaataaattattaaggccaggtgtggtggctgacacttgtaatcccagcattttgggaggctgaggtgggaggatcacttggacctgggagattgagaatgaagtgagccattatcatgccacgccactgcactcgagcttgagcaacagaatgagagcctgtctcaaaaatttttttctaaaatttctcagtttcaatttatcatatagttttcatatatatatataatatatatataatatatatttaaaaagctctttgggtcctccatatttttttaaatggccaggaaatgttgatctatggcatgaaatagagatctgattttattaatttttttttttggagatggagtctcactcagtcacccaggctggagtgcagtgacacgatctcggctcactgcaagctccacctcctgggttcatgccattctcctgcctcagcctcccaagtagctggactacaggcacccgccactatgcccggctaatttgttttgtattttttagtagagacggggattcaccgtgttagccaggatggtctcaatctcctgacctcgtgatccgcccgtctaggcctcccaaagtgctgggattacaggcgtgagccactgcacctggccaatctgattttattttcattttctcatgtgaataaccagtttctccagtagctgaagtagtctatcctatccctactaatttgtaatataacctcttgccattagtatgtttccatattcatttgattgtgtgcctagactctttttctattatatatatttatttgttcatccatatgccaattccactgtctttttttttttttttttttttttttgagacagagtctcactctgtcaccccggctggagtgcagtggcacgatctcggctcactgtaacctccgtctcccaggttcaagtgattcttcagcctcagcctcccaagtagctgggactacaggcatgcaccaccacaccgagctaatttttctatttttggtagagatgggttttcaccatgttggccaggatggtttcgatctcttgacgtcaagatccactgacatcggcctcccaaagtgctgggattacaagcatgagccactgtgcccggccaggaattacacttttagaaatttgtattatacagatatttgcaggaatgcatgaagatctgtataagagaatttcattagagcattgtgtctaataataaaaaattagaatcagtctaagagtccatccatagagaagtggctaaactatggtagaactttagagcaaaatattatgtagctatttggaaaagaatgcagaagatctaattgtatcatcatggaatggtcttcaagatattaagtagaaagtcaccaagtggaaaaacaagtcacagaatatgtagagcatgttcccatttctgctaaaaaaaaaataataatacaaaaactcagccgggcacagtggctcatgcctgtaatcccagcactttgggaggccgaggcgggtggatcacgaggtcaggggatcgagaccatcctggctaacacggtgaaaccccgtctctgctaaaaatacaaaaaaattagctgggtgtggtggtgggcacctgtagtcccagctactccggaggctgaggcaggagaatggcgtgaacccgggaggcggagcttgcagtgagccgagattgtgccactgcatgccaacctgggcgacagagtaagactccatctcaaaaaaaaaacccacccaggtgcatgcccaactactaccagcgatttgtcacctctgagaagaggagtgggattggaagagagatgtcaagggaactcttttctttcctttttaaaacctacttctagattgtctgcattttctataacaagaattaattaacatattgcttgtgtacttattttctttttcttttctttcttttttttttttgagatggagtctctctctgtccctcaggctggagtgcaataatagcatgatctcgggtcactgcaacctccacctcccaggttcaagcaactctcctacctcagcctcccaagtagctgggattacaggtgcctgccaccatgcccggcaaatttttgtatttttttttttagtagagacggggtttcactacgttgactagcctggtcttgaactcctgacctcaagtgatctgcccacctcagcctcccaaagtgctgggattacaggcatgagccaccgcgcctggcctgctgtgtaattctaaataatcatcaggaccatgaacctgaccatctgtgaaagacagagatgtttcctggcaggatagggtccactgccattgatattggcaaggtgcctgctgctccttagcctgctgtaggtaccagattgaccttgagtagaaccagccttgagagaagaggaaaggagagccaggccctaatcatagggatccccaggggtgtagatgatgttaaggcaacatcttctctgtgtctaagagaaaaagaatctgccctgagtatgaactgacttgtgtgctttgaggtcagtgtcctaaacaggaagccatgaggtgagcagagacacttccctgctgcctggggctgggagttgggaagtgagaaaacatcctagtggccaccagaaccatccagtgggtggctctgaatcctgcattgatttgttgggagactttggaggaggagcctggtgtggagggttgagcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaaaaaatcacccacaattctacccgccaaagtcaaccaacatcctgatgcgtgtttttctagtaaccttttaatatttttcctgtgtagctaatatccaactattttactttcccatatcctgcctttttcactcagctctaaattatgatcctagtcccaaatcatcacatattcttcaataacttaactagtccatatggccaaacattgtatgtttccaatttttccactgttataaaggttgctgttgtgagttatcttagtgggctaaactccgattattcctctaggaagaacatggaatgatacattcttctaaagaaatgttctgtgtttctatgctcttccctctactaggaggcacttgaacggagtggttgagagttgtaaaaacctatttttatttatttatttatttttgagacagagtttctctctgaagcccaggctggagtgcaatggcatgatctcagctcactgcaacctctgcctcctgggttcaagtgattctcctgcctcagcctctcaagtagctggggttatagatgtccaccaccatacctggccaatttttgtagttttattagagatgaggtttccccatgttggccaggctggtctcgaactcttgacctcaggtgatccactcgcctcggcctcccaaagtgctaggattacaggcatgagccaccgtgcctggccagaaaaatctatgtttgagtcccagctctctgctgatctacaactatgtaaacttgggcaagttatgtcccctttctggcccttgcatacttacctataaaacaaggctaaagtaatatttactacctcaagggttgctgtgaggattaacgatgtaattactgtaggtagaggtatcttagtccatttcatgttgctgtaaaggaataccggaggttgggtaatttataaataaaagaggtttatttggctcatagttctgcaggttatacaagaaacatggtgccagcatctgattctggtgaggggcccaagaatcttacaatcactgtggaaggtgaaggggaacagacatcacatgtcaagagagaggaagagaaaagaggaagatgccagcttctttaacagccagatctcttgggaattaagggtgagaactcactcaatcctgcaaacatggcatgaagccattcacgagggatctgctcccatcatccaaacacctctcaacaggccccacttccaacactggggatcaaattttaacatgagatttggagggaacagatgttcagaccacatcaaaagggcttagcaccttgttattaggcctagaaagcatctcccccttctcctgcctcttgaccaccatatctagcttcagtgacactccttttgtgaaatctctgatatctgcgtggttaaaattatgctcttcccccaacctcttttttttttttgagaaagagtctcgctctgctgcccaggcaggagtgcagtggtgcaatctcaactcactgcaaacttcgcctcctgggttcaagcgattctcctgccttagcctcccaaatagctgggactacaggcacacaccgccacacccggctaatttttgtatttttagtagagacagggtttcaccatattggccaggctggtctcgagctcctgacctcaggtaatctgcccaccttggcctcccaaagtgctgagattacaggcgtgagccaccgcacctggcctctttccccttttttaaaaaaagaaggcgaaattcacataacatagcattcatcattttaaagtgtacccttcagtggctttatgtacattcacagtcttgtgcaaccatcacctctagatgccaaacattttcatcatcccacaaggaaaccacttacccattgaccccttatccacagtagtcactgtacttcaaggtttcccatatcccatatccagcgtggctggatccaagggatcaaatgccatcagtaggactcagtttttctgcatctacttgtgttggcttcactctcgggcagatgctttccatatggcaatcccagtggctctaagcttacattagccatcaggtagcaatcccaacagagagagatcgtttcattagaagtttcaatggaagtcatgggactgagtattattgcctcaacttggataatttgcccatggctgaactgattaccatggtgggggagaggggaagaggtggcggtagaatattctgattggccaggttctgggtcgtatgttcattcctccaaattgcattcagaaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaaaaaaaaaagcaaacaaacaacaacaagaaaaactaaagtagagcccaaaaccaatttgttggttcccagcttggcttaggcaccattctaagcatattccactagtccctccatctccaaactagtcattcttgggagctgacctacttagtgcacagcaaaggaaataaacagaaatccagcaagtccatcatttgagaggcccatgctgatgactcagagaatatataaaatggcaggttggccaggtgtagtggctcatgcctgtaatcctagcactttgggagactgaggtgggtggatcacctgaggtcaggagttcaagaccaggctggccaacatggtgaaaccttgtctctactaaaaatacaaaaattagccaggtgtggtggcacaatcgctggaacttgggaggcagagactgcagtgagccgagatcgtgccactatactccagcctgggcaacagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagcaattcttgccatcttacctagcaggaaaaaccaattgttttatcaagtttgccagcataagattgaaatttaaagcctttaatatcttagtttataaaagacaagttacagaatgtctctttcctggatgtcttagaattacagtatcttttagggcaggagtctgtgaacctttgcttaaaggactcatggtaaatatttttgtctttgagggccatattgttaaaggaaaggggtcccgatccagaccccaagagaggattcttagatattgtgcaagaaagaactcaaggcgaatccatagagtaaaatgaaagcaagtttatttattaagtttcttaagttattaagaaagtaaagaaataaaagaatggctactccacagccagaacagcagcttggactgctcaactcataatgcttaacagttttttctaaattatatgctaaacaaggggcgaattattcatgagttttctgggaaagaggtgggcaattcccacagctgagggttcctccacttttaagactatataaggtaactgacattgccatggcatttgtaaacagtcctggcgctggtgggcgggtcttttagcatggtaatgcattataattagtgtggaatgagtagtgaggatgaccagagatcatgtgcgttgccctcttggttttggtggcttttggccagcttctttaccgcaacctgttttatcggtcaggtctttgtgacctgtatcttgtgccgtcctcctagctcatcctgtgacttagaatgcctaacctcctgggaatgcagcccaataggtctccgcctcattttacccagcccctattcaagatggtgttgttctggttcaaacgcttctgacagtatggtctctgtcccagctactcagccctgctgtaacacaaaagcagtcatcaacagtacctaaacaaatgggcatggatgtgttctaataaagctttatttatagatgctgaaatctgaattttttgcagttttcatttgattccacgctgaccccttgccccccgtccaaatattcacaaatgtaaaagccattcttgtctcacaggctgcacaaaaagaagtgatgggctggagatggccttggggccatatttttcataccctgctttaggagacagtgcattagcattctgacagcaggcaggggaggtacaagatgactgtctactgcctcttgggttctaacaccccagatgcatgttgaccccctgctgcttctcatcatgcgtttctcttaaaagatacatagtatttgtggggctgggcgcggtggcccacatctgtaatcccagcactttgggaggccgaggcgggtggatcacgaggtcaggagagcaagaccgtcctggctaacacagtgaaaccccatctctactaaaaaaaaaaaaaaaatacaaaaattagctgggcgtggtggtgggtgtctgtggtcccaggtaccccggaggctgaggcaggagaatggcgtgaaccgagatcgcgccactgcactccagcctgggcaacagagcgagactccgtctcaaaaaaaaaaaaaacaaagatatatagtatttgtgtgactttcttggttttgtgcaacagaaaactcaacccaaactgcatatgcaaaaaaaaaaaaaaaaaaaaaggaatgtactaaccggggtttctacactctaggggtggttgaggcaggagtccaaagtctatctgtttatccctcagcttttatcccctccatgagggctttgttcttaggattcagggtttcttttcccccaggggggttcacagcaaagttctgggtctgactacttctggtgtgtatctgatcctatatctatctgaatctgaacgggaagggaacacagtgagcaccttaggccacacctgggtagggtaagccccattaaatttgcaagtcctgggagcggtggtgccagttggttccccaaaggaaacaggtcctattacctaagaaaggtgaatggatactgggaggcaaatcaacaaatgtccattgcacatgaggacatcacactgtgacatttagaatctaaatgctctgaacaaaatgtataggggaccttccaggaacgggaaattgctgttcctaccccctctttttggagaaattgctgttcctcccattggcaaaattcccctcgcaggttccagcttctttctcttagaacagaccttctggtttggcaagcccagtcccacatcgaggtttagttctggacttctgtgcagggtcatggcactcgcttgattgaaattttgtttggggaagcaatgacctgaagagcttacagcctgggtcaaccactcaccactctcaggaaaagcagacagagccaaactttctagctgggctcaaaatagctattttctgacgtgggtcctccatgactcatggtggagttttccaggctcgaggggactgttgacatttactctgctcctcccacgccacagagtctaactttttctatcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttcaagagatgccaggcagggaactctcaggacacataccaggcctgcactggcatatgtattttttggagacaggatctctgtcactcaaaatagagtgcagtggcgtgatcatggcccactgcagcctttaactcctaggctcaagtgatcctcctgcctcaaccttctgagtagctgggaccactggcatatgccaccacacctagctaatttttcaaaattttgtagagatggggtcttgctatgttgcccaggctgatcttcaactcttggtctcaagcaaccctcctgcctcaacctcccatagttttgggattacaggcatgagccactgcacccagcctcggactgctactttagaccccactttcttgtccaggtgtgatcctgggtgcgtgtgcccagagacgccctggctacctgggattcatccatcaaacacctggtcattcagccaattctgtgcgaacagcaccttcccggctgtcccaccctctgcaaagatctgtgatgctggaaagttgtgtgtggctaagtcggaagaagtgaagttcatctgcataagtgcagtagtgtatttattgatttttattcttattttttatttttatttatttatttgagacagggtcttgctctgtcacccaggctgtggtgcagtggcatgatctcagctcactgtaacctccaccgccttctgggcttgagcaatcctcccacctcagcctcccgagtagctgggaccagaggcacacccaccatgcccggctattttggtttttgtattttttgtagagatgaggtcttgatatattgcccaggctggtctcgaactcctgagctcaagtaatcttcccgcctcggcctcccaaagtgttgggattacaggcgtgagccaccacgcccagtccagtagtgcatttactgatagcacttactgcagctattttcttttattgcatttactgcattcctgctatgtcccaggctttgcacacattagtaggcgttcgatcctttaacaattctttgaggcagtagcaggtcttcctatttctatacttgctcccttagtagatcacactctcatgggaaacacagtgacttttttttttctttctttctttttttcagacagagtttccctcttgttgcccagtctggagtgcaatggtgagatcttggctcactgcctcagcctcccaagtagctgggattacctgccaccacgcccagcctgattgtattttttaaaattaaaattgaaataccatcaataggttgaccactaggactaaaatccaaacttttcagtgtggcctataggccgggcatcatggggccacttcctgtctctccatcttggaacaccccttcccttcctcattttgctccacccacatctgccttttctctttcttttagagacaggatctcactgtgttgtcacctctcacagcttctgcactcgtggatcctctatctgaagcattcttccccctccgtcttcccaggccagcttctgctggtcattcagtgtcagctcaaatgccactttctcatagaggtcttctgtgaccccgctatctggaggagtccccgggatcaatcactgtctacccccgtaatggcattttactctcttcctagccctgtccacctaaatgatgttgtttgtttatcttttggcttgctgtctgtcttcatcaggaggatggatgtttcatttctgcatgcctagctcctagaatattgcctggtgtgtggcgggcatgttgaataaacaaagagcccccaaatgacataggaggccatgccatgtgccccagtccctgcagaggagcgaccatccaccagcagaccctgtgtctttgaaaggaattccagagagagtaaaaatcagtgcctatgaaaagtatcccaactggctgcaccattgcctagcttttgtgctcagtgtttttggttttgttttttcgacatcattggcttttaaagccaggtcaacctttggacttgaaccctcaggttttgcatctcccgctgcactgctgggcagtcgacccttcccaaaccaccagttctagctgagacacacacgaggttctggatttttgctccaccagcaggtgatcctcttcatcttccattgcaggcatctttttctttaattataaaaataacaccatactccactctcaaggaagcactcataactccctaccctataagtgtgggctgtgtatagtgacttccttccaaagaggaagtgaaaggagaaactttacaatggagaaacctggcagacactccctcagccaggggctcaaggtcagcatcaacagtgccaactcatcttgatgggatgtaccacggatgtgaagtgatgagaatggtggccgggcaccatggctcacacctgtattcccagcactttgggaggctgaggcgggtggattacctgaggtcaggggtttgagaccagcttcaccaacatggcgaaaccttgtctctactaaaaatacaaaaactagccaggcatggtggcacacacctgtagtcccagctactcgggaggctaaggcaggagaatcgcttgaacccaggaggcggaggttgcagtgagctgagatcatgccactgcactccagcctgagtgacaatatgagattccatctcaaaaaaaaagaaaaaaaagaagaaagtgatgagaatggtgacttacctctgcagtcttctctccaaactcacaacttgtctcaccatcagaaaaactcaaaattaaagggtattccactacaaaatacctgtgcagtaccccttaaaactgtcaagggcaggctgggctcatgcctgtaatcccagcactttgggaggctgaggtgggcagatcacctgagttcaggagttcaagaccagcctgaccaacatggagaaaccccgtctccactaaaaatacaaaattagccaggcgtggtggtgcatgcctgtactgccccctactcgggaggctgaggcaggagaatcgcttgaacccaggaggcggaggttgcagtgagctgagatcatgctactgcacctgagaaactgtcacagtgtagaagagtctaagaagacacaaggactgaatgtcatgcactgtcctcgatgggatcctggaatggaaaaagaacattggcggaaaaacaaggaaatctgaacagagtatgcattttaatctttttttaaatcccctaaggatttccagtactgatgctttgcctttgtgcttgagatccctgtttagagccacatctcccttctggtgtggattttcagtccgacatgaatgcttccagatttgcttccttccttcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaaagtcattctgggccaaggtgtttgaataaagtggttgatcaaatgaaatttaatgtaaagttattttaactgcttttcttgagtaacgcataaactgatttgaaagcaacaaagaatttgtttattactacctctccttattccagaaaggacttaatgatcttattggagccttaaaaaagttttaaaaggctcaagaaatgttggtaaatttccttttttttatcttttttttttttttttttttttttgagaaggagtcttgctctgttgcccaggctggagtgcagtggctcgatctcagctcactgcaatctctgcctcccgggtttaagtgattcttgtgcctcagcctccagagtagctgggattacaggcatgcgccaccacccctggctaatttttgtatttttagtaaaggtggggtttcaccacgttggccaagctggtctcgaactcctgacctcaagtgatccgcctacctcggccttccaaagtgctgggattacaggtgtgagccatcacgcccggcctaatttacttttattattattattattattgttgttgtttgagacggagtttcgctctgttgcctgttgccaggctggagtgcagtggcgtgatctccacctcctgggttcaagcgattctcctgcctcagcctcccaagtagctgggactgtaggcgtgcaccaccatgcccagctaagttttttgttttttgttttttgagacagagtctcgctctgtcacccaggctggagtgcagtggcatgatcttggctcactacaagctccgcctcccgggttcacaccattctcctgcctcagcctcccaagtagctgggactacaggcatctgccaccacgcctggctaattttttgtattttttagtagaggtggggtttcaccatgttagccaggatggtttcaatctcctgacctcgtgatctgcccacctcggcctcccgaagtgctgggattacaggcgtgagccaccgcgcctggcctacttttattatcttaatatcactcttctcatttctcttctctaagcctaatattagtatttgtggacattgcaggtgggacacaagacctttggtgcttctcatcttccaagagggcacagaatgggatggtgtatgaggtgggatattcccagccaagggagttctgggagggaggtgaagttggggcaaagaattcccatgggctaatgtcctctgtgcttccccaaccctagttccagctgatgtggaattctgagtttggctgctttttcttttgttgatggtggtgatggtggtggtggcaatgatgatgatagtgatgttgatggtggtggtggtggtgatagtggtgatggtgatgatgaaaggggtggtaatgatggtggtgatggtgatgatgacagtgatcgtgatgatggtgatggtgatggtggggatagtaatgatggtgataatggtgatagtgataatggtgacgatgacagtgatgtgctagtgatggtgataatgacagtgatggtggtgatagtgatagtggtgatggtgatggtaaagataatggtgatagtggtgatgattatgatagtgatagtgattatggtgaggatagagacagtgattgtgataactgacattcaccaagtcctcactgtccttatgatgtaccaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgggattacaggcatgagccactgtgccaggcccacaagggaaattttttaaagtggaaactcagagaatttaaataacttgtccaggggcacaaagccaggcaggggcagagccaggcaggggcagagccagcctttcaccattcaccattgctggctttgaacatgaagcaaggggccataagccaaggaatgtaggtggccaaggaatgtagaagctagaaaaggcaaggaaactcattcttccttagagccccaagaaggacaggcaatcctgctgacactgttaccaaaacaccaggggattcgtctaggtcctgctgctcactgcacagaaggccgacactgagacaacaattattgctaaggaaggaggctttactcaggtgttgcagccaaggagccagtaactcagtctcacatccatctccctgaccaactaaaatcaagggtttatacagcagggaagagatgtaacaatgtgtaacaaaacaggaacttgggacgggcaaggaagcaatcccgatgaatgaggggtctggcatctcattgtctggatgctgtaatctggtgagtttcagttctttgatacttatttgagaggcaaggaattccctcctgaggaaggaactcagataaaacaaactttaagtttcaagagttaagaccagaaaggtcaatttctatgtttatcaagaaagaaaaaaactgtctatgggactacttgtgttggtttcaacaccctgattttcacgtccgttgggcctctgtcctccagaactataataaatgtgtgttgttttaagccactaagtttgtgtttatttgtaactgagacacagattggcatttttttccactgtcacccctcttgccttgtatcatcagttgttagtatttgttttagctggggaggcagctggagcatgaagtcaacaggaacaatgatgatctgcagggaggaaagccctaggatggcgggataatccccattgtgccccctcatcattagccacagtacttggctggcatttgagcagagtggttatcacagcagcgttcactctcctgcccccgggttcctgttcttccctctcttcaagagcactcaatgcatatctctccaaaccagtgcttctccacctttaatgtgagtgataatagctaacattcagcacactgtgctcaatgtgtgaatcccctcacttaacctccataccaacccttgagatagatgttatcattatccttcccatttcaggaaactgaggcatagagtgtttaatgaagaatcacctgcttgaagggcagcttgctgggtctcctccagggagattttgattcagtaggtccaggagaagcccaggtagatggattttttttttttaatcacacctaggtaagtctcatacctgtgccctgggagcacaataaaaaaactctgggtttaggctgtgtgcagtggctcatgcttgtaatcccatcagcttgggggtctgagatgggaggatcgcttgaggccggtttaagatcagcctgggtgacatggtgagactccgtctctacaaaattaaaaggacgtgatggtgcacacctgtagtcccacctattcaggaggctgaagtgggaggattgcttgagcccagaagcttgaggatgcagtgaggtatgatcacaccactgaactccagacttggtaatagagtgagaccttgtttcagataaaaagaggaaaggaaagaaaggaaaaaagaaaggaaaggggcaaaaggaaatgggaagggaagggaagggagaaaggaaggaaggaaaaaagaaagagaaaggaagaaagaggaaggaaggaagggaagatggaactaaggaaggaagaaaggaggaaagaaagaaaaaggaaggaaaagagagaaaggaaagaaggagaaagactctgagtctaaacccgtggttttcaacaaagggtgattttgtcccccaggggatacttgccagtgtctgaggacattttgggttggggagaggatgctactggcagccagtgggcagaggccagggatgctgctgcacagcctacagtgtttagcacagcccccagcacaaagaagcgtccaactccaaatgtcaaagcactcacaggctatggagcagcagtgagatgaagctcttgctctagccttggctcctgcactcagaatgagtcttcagatgttctcagattacacttccagaggattaggctggaatttgtctttcttgtgaaagaaactctttgtctcaagtgttgggtcctcccaggattcctccccaaatgggctatcttagtttctcctctactcctcaatctcacctcttcaccttcatccttatttcctatttcactgcaaaagtcaagggcccagcctggccaacatggtgaaactctgtctctaccaaaaatacaaaagttagtcaggcgaagtggcaggcacctgtaatcccagctacttgggaggctgaggcaggagaatcacttgaacccgggaggtggaggttgcagtgagccgagatcacaccactgcactccagcctgggagacagaatgagactccatctaaaaaaataaaaataaaaaacaaaaaaaaaaagtcaacggcatcaaatgctctcctctgctccctttgtcatttctttgtacttggacctcttagatcttggacttctatgaggtcacagaggaagagcatgtttccagaaagaaattcctacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtacaggaaaatcccagctgccccttatcacacaatcaatatattcaatcaatatagttaatagcaatgtgccaatgtcagtttcttggtaaagttaacaaatagtggaaattgagtgaggggggtagaggggaattctgttggctctttgcaacttatcactgcccatctccagttttctggtgcctttgctcagatgctgctgtggagtcccctccacagagatacctgtgtccttctccccaccttcctggctcccaacagactacactgcctgagagagctgaagtcaggcattcattctgcaggggattctgggtcacagctgagccagtcctattaggatttagggggcagccgacctgtggggcctgcaccgcacacactccttctaagggtttcctcacagtccctgctgaaggggagggtctcgtgtgacctgtggctccacccaggttgaacgtgctgaggccctgaccaaaggcagggccacccataggctgccaggggctggaggtgggacgagagggtccatcagaagtcctttcatgagagcagttaagagggaagcagaagagtcctgaaatggagaaacacctcagggagacagaatctttgaggaaggggaaggtatcagggagaaaagaaagaaggagatgaatggagggtcccaggatggtgaacaatgacttgggacttgggagcacttgaaatgtggccattccaaattgagatctgttcttcctttatttagttttgagacggagtctcactctgtcacccaaactgtagtgcagtggcgcagtctcggctcactgcaacctccatcccccaggttcacgtgatccttgtgcctcagcctcccaagtagctgggatgacaggcacgtgccaccagacgtggctattttctgtatttttagtagagatggggtttcaccatgttgtccaggctggtgtcgatctcctgacctcaagtgatccacctgcctcggcctcccaaagtgctgggattacaggcgtgagccaccgtgcctggcctgaattgagatctatttaaagggtaaaatatacatactggacttaagacttccatactccctccaaaaaggatataaaacatctcattcgtatctttaatatattgattacattttgaactgataatcctttagatctattggattaaataaaatatgttagtgaaattaatctcgcccatttctttttatctttttttttatttttaagagacagggtctcgttgctatgttgcctaggttggacttaaactcctgggctcaagtgatccccctgcctcagcctccagagtagctgagactacaggcatgtgcctccgcacccagctctttttacttttttttttttttttttttttttgagatggagtccgttctgtcacccaggctggagtgcagtgactcgatcttggctcactgcaacctccgcctcccaggttcaagcgattctcctgcctcaaccttctgagtagctacgattatagtcacctgccaccatgcccagttaattttttttgtttgttgttcttgttgttcttgttgagacagagtctccctctgttgcccaggctggagtgcagtggcacgatctcggctcactgcaacctccgcctccccagttcaagcaattctcctgcctcagcgtcctgaatagctgggattacaggcacacaccaccacacctggctaatttttgtatttttaggaagacgggctttcgccatgttggccaggctggtcttgaactcctgacctcaggtgatccaccgcctcggactcccaaaatgctaggattacaggcgtgagtgagccaccgtgctctgccacggctaatttttatatttttagtagagatggggtttcaccatgttggccaggctggtcttgagctcctgaccttaagtgatatgcccaccacccttggcctctcaaagtgctgggattacaggcatgtgcctccacacccagccttttttattttttagaatgtggttcctggaatgttcaaaattacatatgtggctagtgttctatttcaattggaccgcactgatctatacattctctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaattacttttgtgtcctttgacacgtcagatgtggctggggaaacagaaactcgcagaagttaaaaaaatgtgcttgaggtgccactggagaataacaatcatagccaggatgtgaagcctgtcagtttcctcagccgcaaattcttccatgtggggcgacctcacagagacgggatgtatgggacggcggagtgcaaagaaaggtatgatcgctcttgggggcccagtggcatcctctccacgaggcaggctgggagaaatcgagcagccaggagcttctgggttaaaagcagtgacttcatctctttgggaaacggtgactcattaaaagcaacgggcggcttcccattacattcacgttatagcaagaaggcgaggcacttggtgcatcccgtaataggatgcttgggggttggaatgagcttctttcctacatgaatgattgatgacaacgaagtctagagtgccaccaggagcctttgaaatgcattcagatattggctccctggtcatggggcgcagatctattcccttgggattcaagactctcttttgggtcaatagcagcaactggcttcttgacaaaaggctggagggggccccctctagattctcttctcagggcaggcatgggtctgttggagctgcggggctgtggtctcacctagaggggccaagagatggtccccatgaccatgagtctgtgttcttcaaatttgatggtggctccaattttattttctccccagtgttagtctggcttctttcagggaaaggcactgtgatggcaggaataatgctactgaccactctttgtgatgtctaggcactacaccaagcacatgttgtatacagttggtcctctgtatctgtgggttccgcatccttagattcaaccaattatggatggaaaatattcaggaaaaaaatccacaaattaccaagaagcaaaactttgagtattatgctgaatctgtgtaaatgaagtgatgtgtaggcatcctattagggattataagtaatctagagatgacttaaagtctacaggaggatgtgtggggcttctatgcaaatatttcaccctgttatatccgggtcttgaacatccaaggatttttttttttttgagacggagtctcgctctgttgcccaggctggagtgcagtggcgcgatctcggctcactgcaaactccgcctcccgggttcacgccattcttctgcctcagcctcctgagtagctgggactacaggcgcctgccaccacgcccggctattttttttttttttttttgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccaatgttgcagatgaagaaactgaggtgcccagagtcactgatgcatggctcaagcgtgagagctggactctgaaacccaaaagcccatgcccagaaccactcccctctcttgccctcttcaagggctggcctggctccccatggtgcctgcacacgccaaccccttttcttttctctcttcttaattttaaatctattttgcaaatgtaacatctgaccattggtaaattgctaaaatttcaatgaatatagttaataacaatgcaccaatgtcaacttcttggtaatgttaacaatagtggaaatttaatgaggagtagaggggaattctttatgctctttgcaactcttcttaaattttttttttttttttattaaagatagtgtctcactctgtcacctaggctggagtgcagtggcaccatcatagatcactgaagccctcaaactcctggacccaagcgatcctcccacctcagcctcccaagtagctgggaccacagctgtgtgccaccacatctggctaatgtttacattttatttttgtagagatggggtcttgctctgttgcccaggctggtcttaaactcatggcttcaagtgatcctcttccctcagccttccaaagctccgggattacagacatgagccaccacatccagccacattttctagaaatataaaagtattaaaaaaaaaaagtatatttaaaaacccaaacaagagaaaaggacatattaggtgaaagttgattctcccccaacactgactccccctacctgagtccctcatgtccttccctaaatgcagcggctgtgacccaagtatattccaatgactgaaatgaatagcacccccacccccagcccttcatttaattgcctttgttatatgagctgggttgaaataatcgctcaaaatggctgattcctctttgagtaggacttaacccatggctgagaattgtccttctagcttgagttctcactgaagtttgaatgagaaccgtttgttgagggaccctgggaaccacatcttgccaagtcattttacatcctatccaacacaggtatgaggctgaccaaaacgtcgtttaagacctttccaacgcaaaggactggaattctattctacaacaggggatgggataggtacccccagtggtactttcatgcttgtaccatcaaacagcaatgaatttcccttcaggaaagctacgcattttctccccaattatcaacctttttgattacctaaaggagaaagccacaatttggtgctagctttgtctttaatgcccctagtacttgctgattcaccttgttaagaaagaaaattcaagcttcattctgaaccttaagcaggctatagtatttagcaagaatttaacagtattgctttgtttcctcaggtttattttcatggctattttctaattatgccaagtaagagtcatttattgtctgtggatgtcatgggacatttccgttagggagtttgagtaaaaaaagtcaatgtcggccaagcgcagtggctcacgcctgtaatcccagcactttgggaggccgaggtgggtgggtcatgaggtcaggagatcgagaccatcctggctaacatggtgaaacccgtctctactaaaagtacaaaaaattaggctggtgtggtggtgggcgcctgtagtcccagctacttgggaggctgaggcaggagaatggcgtgaattcaggaggcagagcttgcagtgagccaagatcacgccactgcactccagcctgggtgacagagcgagacgccgtttcaaaaaaaaaaaaaaaaaagtgaatgtcatgacatactgagtggtatatgacagagtacagaatatgtagctggggtaaattctatgcagtgttgagagttttggaaacactgttttgtagctcttttgaccttagagcatgggcattgggatcagatagatctgggtttgagtttcatttctaccactcattatagcactgccccaattgccccttagaactgatgtttacggtgttttgttttgtttgaataaacacaaaaatttaccttcctaatcttttgtttttcttttttcttttatttttgagacggagtcttgctctgtcacccaggctggagtgccgcggtgcgatctctgctcactacaagctccgcctcccaggttcacaccattctcctgcctcagcctcccaagtagctgggactacaggtgcccgccaccacgcccggctaattttttgtatttttagtagagacagggtttcaccgtgttagccaagatggtctctatctgaccttgtgatccacctgcctcagcctcccaaagtgctgggattacaggcgtgagccactgtgcccagccccctcctaatcttaaaattttagaaagttacattcattttacctgagttcctttctcaagaaactgacctctcggccttccagatagtattaaggaattgaaatttaccagatcactatatgtggacaatgagatgccagactcctcaaccatcacgattgcctaaccaaccacctgcatcctgttgaccagattctcttccttaccccttcctaataatttcccagaaaaaaaaaaaaagaatagggatgtatcacaatgtaacacatggttgcgtttcttccttgctacctctaattttagtgggttgaggagatggatttgagtctctttccatctcctcagctgcagcacccaattaaagccttctctggcaatactcattgcctcagtgattggctttctgtgcagcgagtagcaggatctagacagaacccttgatgttgctgcaacaattgagtgagtgagtttgaccaatcacttatgacctctctaagcctcattttattaatctagaaagagaggttgatatgagctagatcatggctccggtaaacacccaaaatgagcaagctctggggccagtactaggcacgtaaagttataaagcagaagtaaaggcagaggttgtgcagggcaccctgagcttaaattcctaccatgacccctgattggaaaagatgggctaggaaaggtatctctctggtccccagcagtttaaccctccaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccctggggtggcatttggggatgggaagatggatttagctgcctcttcccccagaagtgactcagctcctggaagctcaatgacagcagtggcagttggagccctggggacgtctgtgccttcatgctttgctgtctccacacagcaagcaagctcttgcttggaagtgtgcgtgagagacttgttgtctctagccagcttgaaatgctcctcccgtttcttcccgtgatttgtcctcctcgtggagacattccttggcagctgtcggatgcctgccttctagttggaaaatgtgatcaagaaaggaacagtctagcaggctaatttctatcacacaagttcagactggaaagaagctgactgtgtgtgatattcatttattcaggtcctgtatcagcatttttcactctgatctgaagacctccttcattaaggtccctggacacaacaccccaacccaggtttatcctaatccttggaggtggaggcagggaattgtttcttaaacaacctccctagatattcaccttgcccactgatgtctgggaataactactccctctgtgtctaaagcaatacagtctactcagttttgttatgatgatgatggtacttacgtagggaggtagttcttacatgaatatggttgattacaacaagagctttggagtaagagagatcttgttttaaatctcacctccatcacttactccctttcctgagcctcgacttccccatctatgaaatgggataacagcactgaccacccagggctgttttgagaatcagataaggtaatgcacaggtgctggcatgtgataaatgctcgataaatgttagttattatcgttactgggtaaacctggctttcctaacttttaaactggagagattacagtataccacccagggaaggggttggccaactttttctataaagagccaggtagtgaatatttgaggcttcgtgggccagggagtctctgtggcaactactcagtttttgcaatgcaaaagcagccataaatgacatgtaaatgaatgagcgtgatcagtgtccagaacaactctacttacaacatcaagcatggggctgcgcttggtcccctggccatagggtatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgagaccctgccccaccaaaaaaaaaaaaaaaaaaaaaagatgaggtttacaatgagcccaacacagtgcctgatgcagagacagctcatggcaagaaaggattctaacgatttgtatctgattcaagctttaggcttcgttcctttctcttggggaagaaaaacatccttgagcaagacttttcaacataggtctttgttccattctttgccccaaatccaagctaagcacctggagcctggcaccaccgcctccatcctcccccggggatggaggtaaaatgccagttcctgggatgtgattaattctcttcgtcccacgcctcgccccagggtgtgttgccgttttcagcatctgtcccatggaaatcaggttgcccatctgaactgtgatgagaaaaacaaggatactcatatcgtggggtggttaactacgcactttcgcaggcacaaatgcattcagccctcaccaggaggctggattacgtggttaaggtcacgtggttgtggagtggaaggggggtggggggggagagagagagcacaagctgggtttgaatactatctctgcaatgatctggctgtgtgatgttgaacaagtcactttccttctctaagcctcagagtcatctcagtaaaatagagattaaatgagataatacacagaaagcctccagcacaggtaactattgaattcttgtacagaggaggaaagtgacgcaaagacataaagggactcattcgaggtcttgcggctgatgactagtgtcaaatgaggatttctgacactgcccccgcctagctgttttttgccagaccccacttcccccatgcacttccctcaccccctggtgactcccgctgggacccctgctgcttccagccaaggctgtgctctgtgtgcaggatctcaagcccctggagagagtgacattgttgtcaggaagcttgcaaggctgtggccattcattcttgtgggtttgtggcctcctgaagttcatgtgcatcttaaaacatcagaatgtgaccttatttggaaataaggtctttgcaggggtaattcagatcaggatccagatgagctcacattggattagggtgggccctaaatctaatgagacagaaaagaagacacacagagccacccggaggaagaacctgtgaaaacagaggcagaggttgaagtgatgctattacatccagtggcaaaaaccgtaattacttttgcaccaacctaatactacaaaccaaggagccagcaggggctgcaagggccaagaaaagatccatccctagagcctctggagagcgcgtgaccctgccaacaccttggtttccgacttctggcttcccgaactccaagagattaaattccttttgttttaagcctccccactggccatgaattgttatggcaccacgcttgactctgagataggaatgaatggggggtgtcggacttagaacagctgcctggaccagaggcagctgtgagggtcaaaaagcatgaatttgaagccagacctggactcagctctttcccttgccagcgctgagcctttgtttctttgcgaaaatgagaacctactgaacttgctggcttatggcgaggattaaaagaggtgatgggcagagcaggtgcggcggtcataacgagggcaattgcaagcatatattaaacgtgacgtgccggggtaattcatccctcacatctgttttgggtggtgggctcccttacagaggagaaacagagctgctgagaggttaaccaactccccaaggccacacagccagggaggggcagaactggaactcaaacccaggccatctgatctggtaaggctggtcttctagcttggtagcatcacagcacacagtagcactcagtattaattatctttttttttttagacgtagtctcactctgtccctcaggctgtagtgtagtggtatgatctcggctcactgcagcctctgcctcccaggttcatgtggttctcgtgcctcagtctcccaagcagctgggattacaggcacctgccagcatgccaggctaagttttgtatttttagtagagactggatttcaccgtgttggtcacactggtctcgaactcctgacctcaggtgatccgcccgcttcggcctctcaaagtgctgggattacaggcgtgagccaccgtgcccagccaatattaatatttcgatcctattcctccctccttccctcctttctcaagcctgtcctcactgcttcaatcccaggagccaccacagcatggtgtcagggacagtagtaggacccgaaattggattccaggggccttgaagcataaccagatggccccaggagatctttaggcagcacatcacatgagacatttcctacaaatcctctgcaaacagacatcgctccctctccccaagccacagcctgaggtggctcctctgacctctctccttcctgcttctctttgacactccctcctctccctccactgtgtctcccttttcacccttccctggcagaggctcggccaggtggccagataatcttcgggacccgccatctttagaaggcaaggaggaggtgattgtgaatctctccaatttcatgtttttcccattcacccacctccactctcttcctcccacttatacagttgttcagtgaccccctctccaacccaatagcagattctgcactatttatgttctgcacttatctatttcatgaagtattgttgctccctgaaaatataaaagaagcacacattgctctgagatgctgaactcaaagaggagaaaatcttcaataggctgatgactgacaggtcaaatattttcctctccccatataattgcttggccttttccattgcctttgttactgtttctcttgaaaactgggagttgtcaggccaggcacggtggctcgcgcctgtaatcccagcactttgggaagccaaggctggcagattacctgaggtcaggagttcaaaaccagcctggccaaaatggcgaaaccctgtctctactaaaaatacaaaaaattagccaggcgtggtgacatgcgcctgtagatccacatacttgggaggctgaggcaggagaattgctggagcctgggaggcagaggttgcaatgagcagagattgcatcaccacgctccagcctgggcaacagagcaagacttgctctcaaaaaaaaaaaaaaaaaaaaaaaaaagggggaattgtctcagagagaatgaagagaggccattcatttcaatgtgagaatcaactccagagaattaccttctttctgtctctttagcaaaataaggtgttttgattggtggaggggaagcagataattttggcacatggaacggacacatcacggggtaggtaatggaaaggaactccaatttactgagaatccaacgtctgctgaacaactcagggccgggagagtcccacaggtggacaaatgcatcaggtggactcctagaagagggcgctgttctatctagagatccaagcaggtagggactgacttcagggaagcctgcaaatcacagcgccctaaaccctgtgcacgtgtgcaagggccagggccccaggacatagaaggcagttggacaggtagaaacaggacaactttctctgggcacagtgactcacacctgtaagtaatcccagcattttgggaggctgaggcaggaggattgcttgaggccagaagttccagaccagtctgggccacatagcgagacctcatctctacaaaaagaaaaaagaagacctggtgtggtggctcacacctgtaatcccagcattatgggaggccaaggcaggctgatcacttgaggtcaggagttcaagaccagcctggccaacatggtgaaaccccaactctactaaaaatacaaaaattagctgggcatggtggcacgagcctgtaacccaagctactcaggaggctgaggcaggagaactgcttgaatccgggaggcggaggttgcagtgagccgatattgtgccactgcactccagcctgggcaacagagggatactccgtctcaaaaaaaaaaaagagaaaaaggaaaaagagaacaactttccaaatcatgggtataaggtataccaactttcattattccttgagtataaggaaaaagacagacgcccttgtagaactgaggtgtggggtgggctccatcttgggggcgggtgtggaaggaattagcagatacagatgatgtgatggtgtctcagggtacgccaaaaacatctcctgccccgagtctcccccactaccgatcaaaggccttgaatagcacatcacttatatctcagccattcaccctagaaacatagcccgaaggaaccctgtagatgtgtgcgaagttttcactttgagaacgttcttcactggaacattcttacggtgaaaataattcttacatttttttcctcatgattacagtggggaaaaaataggaaacaacctacatgtctgtggattgcttaagtgcttcgtgatacagccacaaatagaaaaccgccccgccttccatgctgctgccgaggaagaccatccaaggacaggcaggagcgctcaaggcatgttgctaggtgaaaagaacacataacgaaatagtgaggtcctaactttatattagaaaaataagacctacatcacagtggatatatgtatatgcatataatagtataaatatacattcacacgcatatatattaacattttaactgctaacattttagtggactttttcagtctttataaagtgtgtctgcccaggcgcggtggctcatgcctataatcctagcactttgggaggctgaggcgggtgggtcatgaggtcaggagttcaagatcagcctggccaacatggtgaaaccccatctcaacgaaaaatacaaaaattagccgggtgtcgtggcataaacttgttatcccagctacttgggagactgacgcaggagaatcactcgaacccgggaggtgaaggttgcattgagccaagatcgtgccactgcactccagcctgggcaacagggcgagactccgtctcaaaaaagaaaaaaaagtgtgtctgtgtatattacacatattatatatataaaaaaccacatatattcatatatgtatatacacacacatatttatatatccgtatgtatgctcacgcttgtaatcccagcacttcaggaggccaagttgggaggatcgcctgaggccaggagtttgagaccaaccttggcaacatagtgacacccccatctctacaaaaaaataaaaattaaaaagttacctaggtgggcctgtagttccagctacttgggagactgaggcggaagggtcccttgagcccagggttcgaggcggcagtgagctatgattgcaccactgcaccccagcttggatgacagagtgaggcctagtctccaaaacaaatgaaaaaatacttaacactacttggtagtagtattactataagataattatgataaaactttcttctgcctagagtcggctggtcttagaggcttagaccacagggcaaagtggtcgtggtcagggggagcagaggcttagaatctgggaccaggcaggagctgacaaggccttaatcaggcttttgtgagcccacttgtgagcctccactagccatcataacaaagttcccagccaggcgtggtggcctcacgactgtaatcccagcactttgggaggttgaggcgggcggatcacttgacgtcagcctggccaacatggtgaaaccccatcactactaaaaatacaaaaattagccgggcctggtggtgtgcacttgtaatcccagctacttataaggctgaggtgggagaatcgcctgaacctcagaggcagaggttgcagtgagctgagattgagatcacaccactgcattgcagcctgggcaacagagcaggactgtgtctcaaaaaacaaaaacaaggccgggtgcagtggctcacgcctgtaatcccagcactttgggaggccgaggcgggtagatcacaaggtcaggagatcgagaccatcctggctaacatggtaaaccccgtctctactaaaaaatatacaacaaattagccaggcgaggtgtcgggcacctgtagtcccagctactcgggaggctgaggcaggagaatggcgtgaacctgggagatggagcttgcagtgagccgagatcgcttcaccgcactccagcctgggcgacagagccagactccgtctaaaaacaaaacaaaacaaagcaaacgaagtaaattactttggaaaacacattttctggttcccaaagggtgtgctcacgaatacacatttgtggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcaccaccacccagggaagtggatattgtcatctcctgttttaagcaagaccctgaagttggaattgaattcaggccaatctgactccaaaacctttgttctttctgtatcacccacggggaagaaagagggaagggaatgcagaggctgtaccctgtgctggtgtctttcacgagcgcacactctgctctcagataggcctgagttttttttaagcctgtcagcttgggcaggttacttggactctctgaatttcagttccctcatttctaaaatggggaaaaataacaagatggggtctctagcaacatcagagtcacatgggttgaacgttcattatctacagagcacagcattcctgaagagttgcaggtagtctttcaagacaaactctcatttaaaaagttgggctctgagtgtgtggtggtgcacacctgtggtcccagctactcaggaggctgaggtgggaggactgcttgagtcctggagttcaaggctgcagtgagctatgatcgcatcaccacactccatcttgggtgacagagagaggcactgtctctaaaaagcacaaattaaggccaggtgcagtggctcacacctgtaatcacagcactttgggaggctgaggcgggatgatcgcttgagcccaggagttcaagaccagacagggcaatgtagccagaccctgtctctacaaaaaataaaattagctgtgtgtggctgtgtgtgcctttgtcccagctactcaggaggatgaggtggggggatcggtttagcccaggggttcaagactgcagtgaactatgatcataccattgcactccaacctgggagacacagtgagagcctgtcgctaaaagaaaaaaattaaaaatacaaaaaatataaaaacatcaaattaaaatgaaaaagtttttttaaaaattgggcttttgccgacaaacagtgaaaggttacaagcaaaaccaaaccaaaccagaggttaagaggcaacctggctggaaaattccctgcgctgcctgtcagctcacccacccacccaccctccactggaagcagcaggaacatcaaatcttttaggcaggctaggcccctcccctattctttcactgatttttcacaacaccaagaggctgagtctgtgatcatcccattttgcagatgaggagactgaggcttgaagaaatgaaacagcctgcccaaggcctcccagctagtaaatggggagttagggttcagactcagctctttctgcttttaaaacacctcttctttataaatttttagttacttatttagataaagggtcttgctctgtcgtccagggtggaatgcagtgaggccgtcatagctcactgcagcctcgaactcctgaaagcccatactctcactgggacgttatatgaccttccctctcgccacataaaatgaactgcagtattcacagctgtcatttatccagccctttgcatgtgcaagaccgtgagctaaatgcttcccatgcataattccttttcacagacatctctgaggaaggttctagaacatttccacttcatggctaagaaatatcttcccttttgtctggaaataagctaaaatgatacgtgagcattcagaaacaatcctttcctccctgtgttttaaaaggaagacagagaggccaggtgtggtggctcacatctataatcctagcactttgagaggcggaggtaggtagatcacttgaggccaggagtttgagaccagcctggccaacagggcaaaaacccgtctctagtaaaaatacaaaaaatttagccacgtgtggtggcgtgcgcctataatcccagctacttgggaggctgaggcacaagaatcatttgaacctgggaggcggaggctacagcgagctgagattataccatttcactccagtctgggcaacagagagaaactatcccaaaataataataaaataaaaggaagacagagaacatgagtcttgcttttaagtaatcaagatcaagatccctttgtttaaaaaaaaaactacaaaaatacaaaaaatttaaaaatacaaatacaaattaaaaattttaaaaatatatatttatttttatttacctaatggtgctgctgcaggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtattgtggatgtgtgtgtgtggatgtgtgtgggtgtgtggatgtgtgtgtgtggatctgtgtgtgtgtatgtgtgtgtgaggatgtgtgtgtgcatgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaataactagcatttcttaagaggcagctctgcagtaagctcttgacttgtgatctcattgaatgtcctcatctagcccatgaatctgaccacttagggacaaatgtcaacagtagaccctaggataaatcaaattatctaaaggatacagaaggacctgagtgttgttaggacatagatcagggattctgtgacattttccaggggagggacccccttccaggcccccagatgtcttgctggaatggagtcctacagacagtattggatggtgatgacgctccccaaccaggctcagccttgtatggtgtgtagcttgcccagtggtgcacctgcctcatcaatctcagagatagacggtggacactaaggcaaccaggacaaaggacacagtatgctcagatctgcacaaagtcctcatccatcatcctcagccctccaggccaacaggctttgagccaaggccctgcttgaattcactttcttggctgttcctcagagatggtttttcccgaagctgtggggcttatcctgtgagtgtgtcctgttcttatctccattttggatgggaagtaatgggaggttacaaaatttgcctgatgctgcattagctaataagtagccaagctaggatgcagtctgactccagaatgtttattaagtgaatcagggaaggagggaagggagtgggagagaagggagggggagagggaggggagaggcggacaggggaagggagggaagggaggaaagaaaaggaggaaggaaggaagctttgagtataaactaccaagataattccttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtgtctcacttccaatgcttctcgcagcattaactcttttatttttatttcttgtgacagagtctcgctctgtcgcccaggctggagtgcagtggtgcgatctcggctcactgcaacctccgtctcctgggttcaagcgattcttgtgcctcggccttccaagtagctgagactacaggtgcccaccaccatgcccagctaatttttgtatttttagtagagacaaggtttcaccatgttggccaggctggtcttgaactcctggcctcaagtgatctgccctccttggcctccttgggattacaggtgtgagccactgcacccagcctgcattgactcttttaagcatgagtccgggggggactgcctgccccagccccaaagctctggcaccctcacatttagattatttcatgggcttcctttttctcagctgatttaacttgtcctttcccccaagatccacagcccctgcctgttcttcctcttttcctgccacgacagtgaggaagaagaggagggagatttccctactcccagggaatggtgagaactcgggagatgtgggatcagaggtcatcatcctggctctctgacgtccttggtctgtgaccttggacacatgagggagcacacagagttgctgtttcccgcgggcactgatatgccaccctgagtgctacgtcccctgcatgcattcaccccttaattttagcttcttgagtcctcgcaagaaccccaatagagtaagttctatctcttttattttatgaatgaggaaattgaggtcggagaggcaaagtgacttgttcgaggtcaccagctaggataaagtagtaccaggatttgaacccaaggtgtctgtctcgtgggggcagagcccttaaccttaagctgttctgttatctttattctcaatgccaggaccccttttctctttgccttactcttttacaacgcaaggacaaacccccgattagatgcccccagtcccacacttggtcttgtcttgttctgcaatgttgaattgtgtgtggtggaacttggacagattttactaagtcaggctttggacttttctgtaccattgaaactgacccaatagtcccatcatagatgttctttttttttttttttttttttgagacaagagtctcgatctgccacccaggctggagtgcagtggggcacgatctggactcactacaagctccacctcccgggttcacgccattctcctgcctcagcctcccgagtagctgggactacaggcgcccgccaccacgcctggctaacttttttttgtattttttagtagagacggggtttcaccgtgttagccaggatggtctcgatctcctgacctcgtgatcctcccgccttggcctcccaaagtgctgggattacaggcatgagccactgcacccggcccatagatactcttttggataaatacagaagttgacctttctgatcttaaagcttgaagccctcatttgtcttatctgagttatttcctcaggaagggacccccaggcctctcaaaaaatatcaaagaactgaaactcaccagattaccacatccagagatgagataccagacccctcattcatcatgattgcttccttgctcctcccgagttcctgttttcttcatgattgcttccttgctcctcccgagttcctgttttcttatacattgttacatttcttccctgctatgtaaactcctagttttagttggtcagggagatggatttgagactgagctcccatctccttggctgcagcacgcaattaaaatcttccttggcaatactcatcttgtcagtgatgggctttctatgcggcgagcagcaggacctagaccaaacccctggtgtttcagtatcaccatttctctgcacataaactgtttatttcagagaccaaaatgatgagctccaatgcagacagtcaaagtttgtgaagtcagtctgctgggaatgtgctgtagaaaaagaacccggttcccgtaataactcttaaggcccacaacagttggcatttacagaccccttattgtggacctaggcttgtgctaagccctttacacacatgctcacataacccacatcaaatgcttactaacagaaagatgcatcaggaaccaccccaacccaggacacccacttgccctgaatcaggcccaggaggtcaagttcacagaccagccataagtgagctcccagcaggcaggtgtgaactctgagtgtgctcctcactctgaatttccagtgtgtgttcccttgctgacttccctttgcttgacccctggtttccaatgtgcaaaatggcatttagagatctctttcttgaggcttggcaattttatcaactttactggaacagggcagtaacacaaaactgcctccggaaaacaggcagcaaacatctggcagataatgcttgaaacgcctgtgttttctcacttcttgaccctatgttccacccacctcctagtacctcccactgctaccccatctccctacccatcctgcccccatcttactgcaggcaagaactctcagaggctgtcaacaacctcagactcattttctcgccttccttccagcactgaatcacatcattagtttttaataattcttcttgcagcccctctggctcgcttcagcttttccacatctagtctaccaacccgctcctgctgtttatctgggtttcagataattaagtatctttggcctccacatggggcaggggtgtggttatcttccttttacacccgcttgctggattttcataaaaagggatagcatgccctgccactcagcttgctctgggcaaaagcaggttttaatcagccagagacagaactgcagcaggcagggaaggtaggcgtgcgaaggacatatttcaagagcacagcctttgagttccaatatttccagagcctgggcttgaaatccagtaacttcgttttattaagaggtaccaagtgtggtaaagaggacaggccctgggaacctggcagagattcaaaatggggtaatagtgcatgcattgtgttgaaaaccacacacacacacacacacacacggaaagtgtgtgcattgtagatagcagttcttttaaaacattttctatgctggctagttttctagtgttttattgttttgattcatataatcctcactatcaccatccaggcagaaaatatcacatagcctttattttatagatgaggaaactgaggcactgagaggtcaagtctcttgcccatggttgtacagtttccatgaaatagcattctaagtccagatgaaatgggaaaagttcccttgtccccctcgcagggtgtgtgatgtcggagtggctcgcttcttcagtgccccgctgctcaaacctctaggggaccatagagatgggccagttgtcgggatctgatcccacggcagtgtctaggggtggatgtttacaactcctgaagcttcagtgtgtgtgtgttacatggtgctcttttagttttgctatctataggcggcttgtgttaactagctcaattagaccctctacgttgtcccaaggacagagggctttctgtatcctgggttcttgccttggtgcaccagaagaatcggatcacacctggacttggagaatgagagcaaggttttattgagtggaggtagctctcagcagatgggggaagccagaaggggatggagtgggaaggtttccccctggagtcaggccgcccagcagcctgggcactcctccgactgcccaggccaaactccactttgttccgccagtagatggcctgccagcatctgtcatgtgctcttctgccagcgtgttcctcttgacgtcttcttgacatccagacgcttgtgtcttctttgccgatctgcagctcttgacgtccagcagcttgtgtgtcacctgctagggtcttggggtttttatagatacaggatgggggcatggcaggccagggtggtcttgggaaatgcaacatttgggcaggaaaacaaaaatgcctgtcctcacctaggactgtgggcacaggcgtgggggtggagcccttaccagggaccacaccctcctctacccagcacttcccttccttccttctgtagcatttaaagcgaccatgcccttcccttcctatcacctctcttgcatatcacagagtccatggtctcagtcatcaagctgtggggtctctcaactagctttgaattctacttcttaccaactgtgtggcctggagcaaatactttgtcctgtttcagcctcggcttccccatcagtacaagggggacagtgatatctccctgcagcatcatagcaagggatgaaaacagacacaggtatgaaattgggtggcccttcctaggtagtaagcaattcaaaattcccttctttcctttcattgttaacattgtgcttcgtgggagagtagggcatcagggctgcttatggttgtctccagagaattcccagaaaatattcctctccccaagagaagatgggattcactgtggtttccttgagatcctcttgggaggtgccaactctcttgagagtggctctcaaccattaagtgcaactctaccctggggccttgattttattatgatgattatttaagatttttttataaacctgcattttttcccctttaatgagctgataattctgaagtctgttaggaagagcttcaagccaagggcaaaatgaagcatgtgcgtttatgtaacttgacacatttcagccacattcaggagctctgcgtcactttagttgcacacagggttttaaatagcatcttccaggaacaggtcaccattgccggggccactgtacatatcggatgggaagagatgcccttaattgcagaagatctaagaagcagtttgtcttggacaaaatatacaagaagttggggtgtaggggagggaaaggaaggaagaagaaacggagagactaaagggaggagagaggagggagaatttctaagctagacttctgaatggaaggaccctcctcctgaatttctaaatgtactgggaggtggggaggaaggtgggaatctgtgttgattgaatggagaaatacatgttagtctgggcgcagtggctcatacctgtaatcccagcactttgggaggctgaggcaggtggatcacctgaaatcaggagttccagaccagcctggccaacatggcaaaaccccatctctactaaaaatacaaaaaaattagctaggcatggtggtgtgcacctgaaatcccagctactcgagaggcttgaggcacaagagttgctttaacctgggaggcagaggtttccatgagccaagattgtgccactgcattccagcctgggtgacagaatgagactctgtgtcaaagaaaataaataaatcaaataaatgttctgtacttgacaagctcttgctgctacgagttgcctttcatggtcagaacaagtttcgagaaggaaaatactctctagaagttccgtcttcctagaactgtattacattctgctcagaggaccacctctgaaccacctagactccattgggttgggagggagattaccatgtaagaccctggtgattatcaattttatgcatcaacttgagtgggccacagggttcccagatgtttggccaaagattcttcgatgtatgtgtctgcaagagcattggtggatgaaattaacatttgaattggtaaactgagtaaagcagactgccctccctaatgtagaggtgggtgggccccgtccaatcagttgaaggcctgactacaacagaaagggtgagtaggagggaactcctgctgcctgattgcttgggctgggacatgggtcttttccggcctttgaacgcaaactgaaacatcagctcttcttgggtcttgagcctgccagcctttggactggaacttaacaccgtcagctctcctgggtctccagctgccacctatagatcttgggacttcttggcctccaaaatcccatgagccaattccttatcataaatctttttccaggccaggtgcagtggttcacgcctgtaattccagcactttgggaggccaaggtgggcagatcatttgaggtcaggagttttgagaccagcctggccaatgtggtgaatccctgcctctactaaaaatacaaaaattagccggctgtggtggcgtgtgctttcagtcccagctactcggaaagtcgaggcaggagaatcgcttgaacttgggaggtggaggttgcagtgagccaagattatgccagtgcactccagcctgggcaacagagtgagatcccatctcagaaaaaaaaaaaagaaaaaagaaaagaataaagaaaaaacaaataaaataaatctcttcagtagtattggttctgtttctctggagaaccctgactgatagagccctttttattctcagaaattttcatttggatagtttatcaggttagcaaagacctagcaagttggataaaatgaaaatatagggaaattggccttatctctttggaaaacagttcattgttacctagtaaagatgaacaggtgattataacctgcagttttgctcctgggtctacccctggttagccagtagcttcatgtggctatttcagtttaaattaattaaaattaaatagcatgtaaaattcagtctctcggtagcctgagccatatttcaagcactcattagtaaataatggctagtggctaccctattggaaagcatacatttgtataggacatttctattgttgtagaacattctattcaccagcactgccctagagaaactacacatgagcatcaggaggcatgttccagaatgttcataactgcctcgtttgtggtctagctgtaccacagaatactatacagcagtgaaaaatgaatgagcaacaggtatgaacatgaaagcatctcaaaaacaagatgttgagcaacaggtttatataaagtgtataaaagtaaaaaatataggccgggcgtggtggctcacgcctctaatcccagcactttgggaggctgaggtgggtggatcacaagttcaggagattgagaccatcctggctaacacggcgaaaccccgtttctactaaaaatacaaaaattagctgggtgtggtggtgtatgcctgtagtcccagctagtcgggaggctgaggcaggagaatcgcttgaacccaggaggtggaggttgcagtgagctgagatcccgccactgcactccagcctgggcaacagagcgagactgcatctcaaaaaaaaaaaaaaaaaaaaactaaaaaatataattgttccgggcttcatatatgggtggtaaatgataaaaataaaaagcattaccacaagtttgtgatagtgcctacctctgagggaatgagaaaaatatgagggaatggggcacacggggccgtctaaaagtcacacacagatttttacttaagtaggatgttgggaaaataactgctttattattccataaaaataatataataataattctatgaagtatgaaataatagtaaataataataaaatataataaatcatattttattatattttattattattatagtatattttatataaattttactataaaaataaaacattttatgcacacttatatgtagtttgcacacacacttctattttttaaattgtggcaaaatatatataatatttactatctgaaaccatttctaagagtacagttctatgtcattaagaacattcatactgtgtgtaaccatcaccatccctccccagaatttttttcatcttcccaaactgaaactctgtaccattcaacactcactccccattttccctttcccctggctcctggtaaccagcattctgctttctgtctctgattttgatgactctacatacttcataaaacaggaatcaggccaggcgctgtggctcacgcctgtaatcccagcactttgggaggccaaggtgggtggatcgcctgagctcaggagttcgagaccaccctgggcaacatggtgaaactctgtctctactaaaataccaaaaattagccaggcgtggtggcgcacacctgtagtcccagctactcaggaggctgagggatgaaaatcacttgatacctggaggcagaggttgcagtgagctgaggttgtgccactgcactctagctcaggctacagagtgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaattagacatcattcttgacccctcccaaccctccacctcatatattcagttcatcatcaactggtgtttgttttacctcctaaaataatgctcagctgtccatctttctccatctccatggccaccacccaggttcacatgcccatctctgtcctgcagccagagggattttctcaccatgtgaatctgattataactctcagatttaaacactgtcttagtccgttcctgttgctgtaacaaaattccttagactgggtaatttataaatagaaatttaattctcacagttctggagtctggctgggaagtccaagatgaagatgccagcagattccatacttagaagggctcattctctgcttccaagatggcgccttgcttctgtgatctccagagaggaagggcaccgtcttctcacaagcagaatggacagaagggcaaaaaggactgaacttgctctctcgagcacttttgttagtgcactgatcccacctcctaatggccctcaccccttaatactattgcattggaaattaagtttcaacatgaattttgaagagtcataaacatttacaccatagcaaacaccttccagaatttgttagcatgataaagcccatgagatcttgctggatctgctcacacctcttctccaacttcttttcttcatccattcctcacccccagctccctcccttacacacacacaccactcccttgggcctccttttagtctccacctccccaccccccgatacacacaccaggtcccctcctgccgtgggggcctttttgtttgtgatgttccctctgcctggatccctctcctcccacccccctctccttccctggtgctatgatctgaatgtttgtatcacccctaaatacatatgtcgacatctaattcccaatgtaataatatcaagaggtggggctttcaggaggtgattaggtcatgagggcagatcctcatggatgggattcgtgcccatgtaaaagaggcccagggtagcttgtttctccctttcactgtgtgaggacacagtgagaactcactatctatgaggaagaggtcctcaccagacactgaatctgctgacaccttgatcttggactttccagcctcttttaccatgaaaaataagtgtttgtttgtttgtttgtttgtttgtttgacggagtctagctctgtcgcccaggctggagtgcagtggtgcgatcttggctcactgcaagctctgcctcccaggttcacgccattctcctgcctcagcctcccgagtagctgggactacaggcgcccaccaccacgcccggctaacttttttgtatttattggtagagacagggtttcaccgtgttagccaggatggtcttgatctcctgacctcgtgatccgcctgcctcggcctcccaacgtgctgggattacaggcgtgagccaccgcgcccggcggtgtttgttgtttataagccacctaggctaagaaagggagaatggcagcccaaatggactaaggcacctgataaactctgtcccctcgaggactgagatctagggcatttctggagggacaccttcccagcacttccccagtccctgtcccattaccatccctgcaatcctttccttagaagccttttgtaaatttgtgttcattggtgtgagtgtatgttcaatatctgactctcctcctagatgctgacctccatgaggacagaggctgagctattttcactcccaaaaatgttgacggtacccagcacacagccaaactcagcgtaggcactctgagtgaagattgattgaatgaattaatgagggctcatcttcctgcttctcccacggtcacataatctcaagggttcccttccatgtggcaggtctgggtggtgagaactgcctggctctctgatggttagggtgaacagtgggtccattcataggaaggaacagagtgataatgcagctaagtgcgttattttcctgtggctactgtaacaaacagctgcaaatgtgttaaaacaacacacatttcttttatcttacagttctggaggctggaagtctgaaatcgatttcactgagctgaaatcaggtgttggcagagccgtgctttctggaggctctagaggagaagcctcttcctcattcattccagcttctagaaccgtactctttgcatttcttggcttgtgtttccctcctccatctccgaagccagcagcatggcatagtccagtccctctcgattgaggtcatcctgtcgcctttgctcttctgtgtcaaatccctctgtttttctcttaaatgtatgcctagcattccattattggaacactaagcatgtgggagttatttatatgctacttctcaaggctatcaccaggtctgatttctcaaattcaaaaaattgcaacctcaggcataaatgggtaggggcacttgtgatgacattgagggcccacctggataacccaggatgatctccccatctcaggaccccttaatttaatcacatctgcaaatttcctttttaaaaatatatatttttcagagacgaagtcttgctctgttgtccaggctggagtgcagtgacacggtcatagctcattgcttcctttaattcctgggctcaaacaatcttactgcctcagcctcccaagaagctgggaccacaggcacgtgccaccacacatagctaatttttgaattttgtagagatggtgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgtaagtttcctgaggccttccaagctatgtggaactgtgagtcaattaaacctcttttcttctttctttttttttttttttttttttgagacggagtctcgcactgtcactgggctggattgcagtggctcaatcttggctcactacaaccaccacctcccgggttcaagcaattattcgcctcagcctcccaagtaactgggattacaggcacccgctgccatgcccagctaatttttttttgtatttttagtagagacggggtttcactgtgttggccaggctggtctcaaactcctgacctcgtgatccgcccacctcagcctcccaaagtgttgggattacaggtgtgagccatcacgcccagccttaaacctcttttctttacaagttactccttctcgggtatttcttcatagcagcatgagaatggactaatacagttgggatctcatcaccttgcccaggctggtcttgaactcctaggttcaagtgatcctcccgcctaggcctcctaaagtcctaggattagaagcatgagccaccatgcctggcccaaaatcccttttgccgtgtaaggtaacagattcataggttcattaggacatggatatcttcagggaccattcttcagtctaccatattgagtgaccacagcaattcatataagggccaagcccagagcaggagccacagtgtggcagcaacaatgacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgacagttctaggacaggatgcccaaagagaaatgggagggaataaaactgcaagtgacttagcagagctgccttggtgttttgggtctacacaaccagattcccgagcacccccttaaggcaatatcctgacttacatatttcatgttatgtaattggctgctattcattgagccatcagttacttagatcttgttgtctcctggaattccagtctactgtgtctgtcctcagtcccctaaactcctcggggatctcaagttatattagatcaatccaagacattcctggttgggttctgccaaacgtggtaggatccctgttttgtttttttgttttttttgtttttttttgagacaaagtctcactctgtcacctgggctggaatgcagtggcttgatcttggctcactgcaacctctgcctcctgggttcaagcgattctcctgcctcagcctccctagtagctgggattacaggcacccgccactgctcccagctaatttgtatttttagtagagaccgggtttcaccatattggccgggctggtcttgaactcctgacctcgtgattcgcctgcctcggcctcccaaagtgctgggattacaggcttgagccactatgcccggccttttttttttctttttctttttttttttttttttttgagacggagtctcgctctgtcgcccaggctggagtgcagtggcacgatctcggctcactgcaagctctgcctcccaggttcacgccattcgcctgcctcagcctcccaagtagctgggactataggcacctgccaccatgcccggctaattttttgtattttcagtagagacagggtttcactgtgttagccaggatggtctcaatctcctgacctcgtgatctgcccgcctcggcctcccaaagtgttgggattacaggcgtgagccaccgcgcctggccagatccctgttttttcattactagatatcctggtcttggatggggttgctttctgataaatagacctcgtgcctggtaagtgtgtttacttgctccggattaaattacacctagatttacattctacctctgccatttataggctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgtaagtgctcattaaatgttactttcctttaccaccaggaagaaattgagtttggaaatggatagatacaggcataagtgtagacactggtttctttgtttggaagaggagacacaagagaagggggagattagagggtggaatgatgatcttttccatgtcaaggttgttgaaacgacgagagaagtctcaaggggcacctaagatttgtctcaaaatatctgaaggatattacgtggaagaggaagttcgtttctttctttttttttttttttcctgagatagagtctattgtgttgcccaggctggagtgcagtggttcaatcttggttcactgcaacctctgcctcccaggttcaaacaatcctcctgcgtcagccttctgagtagctgggaccaagtagcagcctcaggtgtaggggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaaaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctcctttatctcagctccctccattccaaggaagacacttacttctcctgtcttatccacagcagctttgccctcttctaagaagccacggcaccaatttatgctgagctcttgcaagtaccaccccaggtgtttgtcaagccataattccaagcaaaaaccattatctccccaagatacatatgggtaccatctgtcaagatgctagcatttcccttcattttcttacacctttactaaactatatttttctcaagtgagcttgagtggatttctgttccttctagtctgtgctgcaatattctattaaaaatttaggctgaatgcagtggctcacacctgtaatccctgcactttgagaggcttaggtgggaggatcgcttgagcctagaagttcaagaccagcttgggcaacatagcaagaccccatctctacaaaaaaactaaataattagctgggcatagtggtgcatgcctgtagcttcagctattctagaggctgaggtgggaggattgcttgagcccaggagtctaaggctggagtgagctatgcttgtgccactgcactccagtctgggcaacagagtgagactctgtctcaaaaagaagaaagagggccaggtgcggtggctcacgcctgtaatcccagcactttgagaggccaaggtgggtggatcatgaggtcaagagatggagaccatcctggccaacatggtgaaaccccatctctactaaaaatacaaaaaaaaattaggtgactacagtggtgtgtccctgtagacccagctgctcaggaggctgaggcaggagaatcacttgaacccagaaggcggaggttgcagtgagctgagatcgtgccacagtactccagcctggcgacagagcaagactccatctcaaaaaaaaaaaaaaaggaaagaaaagaaaaaagaaagcttagctataccgagaactttatttcccatatcccattttgtattagtccattttcacactggaaaaaaaaaataccaaagattgagtaatttataaaatagagaggtttaattgactcacagtttcgcatggctggggaggcctcaggaaacttacaatcatggcagaaggggaagcaggcaccttcttcacaaggcagcaggagggaataagagccagcaggggaaatgccagacacttataaagccctcagatctcatgagaactcaccctttatcacgagaacagcatggaggaaactgccgccatgatccaatcacttccctccctcgacacgtggggattacaatttgcagtgagattttggtggggacacagagccaaaccatatccttttccctgtagggttgtgggttaaaagtaggcagaagaggatggtgcgggagatttgggaagtggaaggaaggtgacatcagtgtttactctttgaaggctgtccagatgagacaaggaggtgatctgacagaggggccacagaggttccagcttgtcctcaccctcccctgtgtcccttgcagcttgtcttcctgaccgctgggcctgctgaccaacagcagcccccccgcctctggatgcttggcagacgaggcagcagccccctagggacccctctacctgtttcccctctgccactccatcttaacagctggacgcatctgactctcatatcagctgtcggtgacttctctcatcctctccacccttcccagaccgccatctccccagctccctggacaattgtagaaggtctaattcctataacgcatcccttgccccagagcacgtagtgaccctgcttccccgattgagcactgactaatatccctcaacagcctttacagaagtagccagaagttggaggcaatgtgtccatcttgcaccaggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgccctatgttagtttgactccttggcacagcagtgggagcctctctctctcccctgtagcctaggatcgtgatcagaatcataatgaaatgtgtgtttgtggtctcccgtggcgtcagataattccgatgccatctgttgtcttcatcatcacatccgttattgaagtccgttgattatgcctttgattgaacctggggctatatttatcaagaaaattataagcacaggctttctgacagtgtccaaccaaacagaatttgtcatcattcaatgactattgctttccatttgttcctgttttggacttctaaaaaccaacacagggtctccttttatttttatttttttaaagaaatcaagtgagctggccaagagcagagcagaagatagatttttcttattcttaattttttttttttttgagacagcatctcgctctgttgcccaggctggagtgcagtggcacaatcttggctcactgcaaccttgtctcccaagttcaagcgattctcctgcctcagcctccccagtagcggggattacaggtgcccgccaccatgcctggctaatttttgtatttttagtagaggcggggtttcaccatgttggccaggctggtctcgaactcctgtcctcaaatgatccacccacctcggcctcccaaagtgctgggattacaggcatgagccaccatgcccggccgagaaatatatatgtatttttaagagacgggctttcactctgttgcccaggctggagtgcagtgatgaatcatggcttactgcagccttgaactcctgggctccagtgatcttcctgcctcagccccttgagtagtggggactataggcacatgccaccatgcctggccaattttttaatttttttgtagagatggggtcttgctgtgttgcccaggctgttatcaaactcctggcctcaagtgattctcctgcctcagtctcccaaaatgatgggattacaggcatgagccaccgtgcgtggctgaaaattcttaaatgtctgccacctatgaaagcattttggagctatagtttgacccaagacgaaaactgctcatttagataatgaagtttaatttacctttgaaagcaacactttgggaaatgcctgaataaactgacatcttgagtcgataggaggcttccccacgtggagtttggtgagctataccaggtcattaaaaagcccttagatgggccggatgcgttggctcatgcctggaatcccagccctttgggagcccaaggtgggtggatcacttaggtcaggagttccaaaccagcctggccaacatggtgaaacaccatctcttactaaaaatacaaaaattaactgggcatggtggtgtgcacctgtaatcccagctacttgggaggctgaggcaccaggatcacttgaacctgagaggcggagattgcagtgagccgagatgtgccagtgcactccagcctgggtgacagagcaagactctgtctcaaagaaaaaaaaaaaaggctcttagattggaagtcagtgctctcattcccccttgaagatggtgactgtttgctactgttccatgtcttcaatgctcatgctgctgcttagacctgttagaactgaccttgagttattccagaggaaaattccagcggatcctagaacaatcagagtattctggactgaagcatagtccagaatcgctctggtgattaaattcggaaagcttgcccagggcatcattaaccgcctggaggagtgagccctctcaccatctgttgtctgccatcactatttggtttttctctttggtctcatttagagccaagttgagaaatttccagttcctctccacttgctgcccgacacagttaaccagaaacacaatgtggtgaaggggcccatgttgtagctaaaacagccctagacttggaggcaggagcctgggttgatatcttggctgtttgactttatagcagcgatccccaacctctttggcaccaaggactggtttcatggaagacaatttttccatggaccagggatggggtgggggcatggttttgagatgattcaagtgcattacatttactgtgcactttatttctatcattattactttgtaatctataatgaaataattatacaactcaccataatgtggaatcagtgggagccctgagcttgttttcctgcaacaagatggtcccatctgtgggcgatgggagagagtggcagatcatcaggcattagattcctataaggagcgtgcaacctagatccctcacatgcacagttcacaatagggtttgcactcctatgagaatctaatgcagccgctgatctgacaggagggggagctcagccggtactgtgagcatggggagtggccgtaaatgcagatgaagcttcactcactcacccgccactcacctcctgctgtgcggcctggctcctaacaggccaaggacctgtactggtggtggctcaggggttgggaacccctgctttatcagacttagttggtccagtttttcccaaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctcaaaaaaaaaaaaagaaaaagaaaaagaatttattttcaggcaaggcctagtggctcatgcttgtaatcctagcattttggaaggccaaagtggaggatcacttgagcctaggagtttgagtccagcctgggcaacatgacgaaactccgtctttacaaaaaattagcccagtgtgctggagtgcacctgtagtacccccagctacccaggaggctgaggcgggaggattgctggaacccaggctgcagtgagctgatatcacgccactgcactccaacttggacgacagagtgagaccctgctgaaaaaaatatatataattttcatgtcttttaggaacaatattaggtttgcatttatggtgatgtaaaaaagagaatcaacataaagaaaagtattaaatagacaataaaagagaacacgcctgtaatcccagcactttgggaggctgaggtggggagatcacttgaggccaggagttcaagaccagcctgtctaacatggcaaaaccccgtctctactaaaaatacaaaaattagcggctctcggtggcatgcacctataatccaagctactcaggaggctgaagcatgagaatcacttgaacctgagaggtggaggttgcagtgagctgagattgtgccactgcactccagcctgggtgacagagtgagaccctgtctcaaataataataataatagagagggcttgaggcatagcaactgttgccatggtaacgtgcaagtgactgatgttcaggaaacactggctttgctaccctgagccacacttttccttcttgcctgcaaggcgataaggatgttgcacctggtggctggtgtgaggaggtcaggcgcagcaagaggcagcacacgtagcagttacagtcacagactttgcctgcgccagggtctgtgtcccagcggagatgcttaccggctgtgtggtcttgagcaaattgctcgacttctctgttactctgtgtggtgttttctgacgccacttctgacaccaaatgtgttttttctgataccaaatacgtgccatttttctacactaagtctctgattcttggatgccaactgggtgcccaagcaattcaattcagctatcacactatgtcctggagttagcatcaggtcctgcaagttaaaagaccccatcccaccagactgcccctatctcagatgccagtcgcaagtccggagccacccacccttctgcctggccaattacaaacttgggggttcccacgaccacctcctcgggtttgatagtttgctggaatgactcacagagctcaggaaagcccttcacttatgtttactggtttattacaaaggacagaactcaggaatagccaaatggaagagagatgcattgggcaaggtgtggagagggagccgtgcagagcttccatgatgccctctctgggtgcactgccctcccagcacaccagtgtgtccaccaacctagaggctccctggatctcactgttcaagagcttttataattcagtcgccagcctcctcctcttcctggcaggtcagcgagtgggactggaagttgcccgccgaattgttttttttttttttttttttttgagacagggtctcactctgtcacccaggctggagtgcagtggtgagatcatagctcactacagccttgacctcctaggagtgagcctcctgcttcagcctcacaagtagctgagactacacaggtgggtgccaacatgcctggctaatttttaattttttttttttttttttttgagacagagtcttgctctgtcacccaggctggagtgcagtggcgcgatcttggctcactgcaagctccgcctcccaggttcatgccattctcctgcctcagcctcccgagtagctgggcctacaggcgcctgccaccatgcctggctaatttttttgtatttttggtagaggtggggtttcaccatgttagccaggatggtctcgatctcctgacctcatgatccgcccgcctcggcctcccaaagtgctgggattacaggcttgagccaccatacccggcctaaattttttttttttttttttttggtagagatggagtcttgctatgttgtgcaggctggtctcaaactcctgagctcaagtgatcctcctggctcagccacctgagtagctgggattacaggcatgagcctctgcatccggcagtgcccccgaccacctgtctttttttttttttttttgagacggagtctcactctatagcctaggctggagtgcagtggcatgattgcggctcactgcaacctccgcctcccaggttcaagcaattatcctgcctcagcctcccaagtagcttggactacaggcacgtgccatcacacccagctaatttttgtatttttagtagagacgggggtttcaccatattggccaggctggtctcgaactcctgacctcgtgatctgccggcctggacctcccaaagtgctgtgattacaggcgtgagccaccgtgccctgcccacccctctcccctgtctttatcacacatttgctcttctggtgacgaggccccaacctgaagccatctctctagggaactcagcctgagtgccctcattagcatacactcagatgtagtacaatggggattgctatggataacaaaagacagtcctatcgctcaggaaactccaggggctttaggagctctgtgctgggaaccagggatgaagaccaaatagatattttattaaccacactagtggcttaatgaattacctcctagggattttttttttttttttttttttttggtcaggagcagatgagataagatacataaaaaagatattacaatacctaaccacataataactgttcagtaaatgttagcagtgaaatgggggagctcccctgtcccctttgcaggacttgtgacaggggtgtggctcgcttacttggctgccactgcatcaaaccccttgcaggagggggagcatgcaggtgagcagattggggctggggtgagtgcttttgggctctggtcccatggcagcgtctagggatgtgttacaattaatactcttttagcagttgctgtacgcagatgactaagtgttaaccagttcagtggagattcagggtgatagccttttacaccctgccctcttggtacctgggttcttgtctggtgtccaggaagaatcaggtcacatggacttgaaggatggtgaatacaaattttttattaagtagtggaagtggctctcagtggaaggggagctggaaaggggatggagtgggaaggtaatcttcccctggagttcagccatcctcagatgatctcctctctgactgtccccagccaaactcctctcgatgttcagacacttcttctcttctctccttctctgccacgccactctggtgctattctgattgtggagcctggggtttggggttcttaagggcataggatgggggcagggtggtccagagcggttttggaaaaggcaacatttgggtgtgaaaacaggaatgcctgttctcatttagggctgcaggtccaggcttgagggtggagccctcacctgggaccctgtccttctgccgcctgtccgtatcagcaggatgctactgctgctgctgatacctggggaattgccaggtgtgaggtgggcattagaaaaatttcaggctgggcacagtggctcaatcctataatcccagcactttgggaggtcgaagcaggaggactccttgagcctaggggtttgagaccagcctgggcaacatcacaagaactcctctctacaaaaaattttgaaatgagctgggcatggtagtgtgtacccataatcccagctactcaggaggctgaggtgggaagattgcttaaacctgagaggtcaaggctgcagtgagctatgattataccactgcatgccagcctggaccacagagcaagaccctgtctctaaaacacaattaaaacaaaaatttcagttgaatatgttcctaagaagccacaaaagagtcttttgttatgattcttaaatgaaaattaactaaaaattggaaataaggaagaatgtcttttccatgtcatactgaggcactgcttaatgacctgcccacggatgattaattatcttggagagagtacatgtatctgactttgttatttattatttgattagagcactgacatagtgaaattacacgttaacttgtagatttctgtccagtagaaaaaagacgacattaaaggttatggttttattgcccttatagcatgttaaccagatttctctcgaatttagcaatcttatgctaaggttttcattaaagatgctgatgagtccactttttaaatgcccttggagcgagctttaccattttactggttccctcattaatgggttaaataaattttttgacaagtgttcattccacatttgtatgagtcacattttaaattttgaaaatatacttcagcatgatcttaataatgccaagtcccagagagttctctgtgcccataatttagttcactgggcacattcccagagcacgttcagtatgcaaagcatcatggtgggccccgcagggaagactaaaatgggtaggactggtccctatagttgcagatttagtaattacttatgggcagaaaagaagtatataaattacttcctacactgtgagaaagagaaaagctgcccctggcagccgggagctggcttgacactcacagcttggccaaagtgttctcctgttgaatgtaaacaattttgcagattgccggcatcagacaaggccatcctgagaccgtgatagatcaagacaaaataacactactcctgaaggcagataaagacatgaacattgtcccagccacaaaaatcacccaatagccccatttcctagctcatatgagtgactgctagttctccatcaatcacagtttcagtcttactctgttcttctccctttaaaggaaagaattaggaagacactctatcagagaattacctccacttcctgacaacatccaatccagagtaaatgctcacttcctttaaactgtcccccaaagcacctaacacaagcccaaattttcttttcttttctttttctttttttttgagacggagtctcgctctatcacccaggctggagtgcagtggtgcaatctcggctcactgcaacctctgccccccgggttcaagcaattctcccgcctcagcctcccgagtagctgggattataggcacccgccaccacgcctgactaacttttgtatttttagtagagacggggtttcaccatgttggccaggctggtctcgaactcctgacctcaagtgatccacctgcctcggcctcccaaagtgctaggattacaggtgtgagccaccacacctggccccaaattttctaataagtgctttctaacaccctcttactgatatctgcccacagctgattaggtgcaagctagcccagtaccaatcgatagaagacagtacagactcactaaagtgatatatgatggagaaaattgtccccatccagacttcccttagagagaagacccggtgtggttggtgggaacactctgacgcttcttttggttagggttgttggccacaagcaacagaaatcaactctgcctgactcaaccaaaaaatgggattgtagaaggctatgagtggggatgggggctcaggagtcggaaggacaggcttggaaatgagtatggatcaagaaagccccagagactggccacaggaccaatctggccaggaagccgccattgctggacagcacaagtctaatccctccatccttttatctctgtcatttgctctgtggtcaaagtcttggacatgagcttctgattggctgagtctgaggaagtgggggtgctcccttgttgaacttctctaataatgactgacacagtgaatgctttccctaaaactagggtttggaggttgagcagccaaaaattccaacttttttccattacaggagggagacacaaccccacccaagaccatgtgtaagtaacaataggtagtctgtaaacagccttccatggccaggaatggtggccaaagaaggtcttctttgacagaggtcaaagaagagggtgggggccaggcacaggggctcacgcctgtaatcccaacaatttgggaagccgagatgggaggattgctttgaggccagaagtttgagaccagactgggcaacatggtggaaccccctctctataaaaaatataaaaattagccaagcatgctagggcacgcctgtatttccagccactcaggaggctgaggcaggaggatgtcttgagcctgggagattgaggctgtggtgagccatgatcaagcaactgcactccagcctacatgacagagcaagaccctgtttccctgtcacaaacaaacaaacaacaaacaaaaacacatacacataaaccccgtcgttctaagcaaagtgagtcctgctatctgcaggattttgatttttttccaagagcattatgctgaactggtatcagaattaaattgcttggaacaattgttcctggatcaaactgagggttgggctgcttattctagtgacccaataacgagatgcaaataaactgggaaaggagggagtttctatttctgttaccagttacagggaaaaagcctggaaaataccaccagaccaactcaaaattacaaagtttcccagagcttacataccttctaaactatatgtccacgtgtaagtgtgcgttcacctaaagacctaaataatcagcttcttctagtctaactaaggtctgagtcctgaagaccttcctctgaagcctcagtaaatttacttaatctaaatgggtccagttgctggggtgattacccttatcttgtctcctgctaaatcatggaggtttggggacttccttcacactcccaataaacttgtttgtggaggcctggggagtttcttcacacccccaataaaacttgtttaatcctaaacgtgtcctgttaagaattgcctcgttatctcgtcatgtttcaaggcccaggaaaggcctgagcaaaactgttggaggatttctgttacattccagcctttgtataagggcactggctcttttagctttttttttttttttttgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttgtattttttgtagagacatgatttcactatgttggccaggctggtcttaaactcctgacatcaggtgattcacccgcctctgccttctaaagtgctgggattgtacaggcatgagccaccatgcccagtaggctccttcagctttgtttttttcttcttcttttttttttttttagtgacagagttttgctcttgtcgcccaggctggagtgcaatggcaggatctcggctcactgcaacctccgcctcccaggttcaagcgattctcctgctgcagcctcccaaagtagctaggattacaggtgcctgccaccacgcccagctaattttttttgtatttttaggtgagacggggtttcaccatgttggccaggctggtcttgaactcctgaacaaggtgatgcatccgccttgggctcccaaagtgctgggattacaggcatgagtcactgcctgcccagccactttcagcttttaatgtttaacttaaccacacagtccctgctgaaatagctgtcatggaggcctgcgttagtgagacctgacctgccacacaatgaaggagatgttcttcattgagataatgtgggtgtccgaatcaggatccacaggtcagtgtcccagctccaccattgactagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccaggctggtcttgaacccctgatctcaagtgatctgctggtcttggcctttcaaagtgctgggattacaggtgtaagccactgcacccgccctgtgcgtggtgaattccgagtaaatggtagccaaaatcattgtcatcatcatcgccacaggtaaccttttccccaaataatactcagcttctcttctaagtaaacgttgaatgaatactttagagtgttgaagaagcacccctaaatctgcccacttgttgattctagccagtgatgttaaatttttaggaatctggagaaccagttgttcaactgtgggtagctcaaaatctgcagcagtgggagtatttacaccgtggaaattggcaaatgattcacagcaaggcttctacctccctcccctgcttccagccagttaaacattccccagcacatcactcattctagtcctagcctgccctactttggggcatccaacagagattacttgcgttttctttgtggtttatcaagccccagggtctcgcttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaaaaaaaaaaatggagtgattgctttaaaattcttaaacagggccgggtgcggtggctcacgcctgtaatcccagcactttgggaggcagaggcaggcggatcactaggtcaagagatggagtccatcctggccaacgtggtgaaaccctgtctctactaaaaatacaaatattagctgggcgtggtggcgggcgcctgtagtcccagctactcaggaggctgaggcaggagaattccttgaacccaggaggcggaggttgcagtgagctgagatcacgccactgcactccatcctggcgacagagtgagacattgtctaaaaaaaaaaaaaaaaattcctaaacaggaggggcttagggccagccagttggtcacatgaaacaatcaggggacttaccttagagctgccttcgcagtagggagtccatggtttttagtgagatttgtgtcgtacaaattaattaaaattgcatagtttctatcaagtttttttcttacactttccacaaaattgggaaaaatgtctatttcccatttctttatttcattttctcttattgcttctatcctacctgatatttcccatttcaaaagcacgtttttttttttgagatgcagtcttgctctgtcgcccaggctggagtgcagtggtgccatctcggctcactgcaagctccacctcccgggttcacgccatgctcctgcctcagcttcccgagtagctgggactacaagcacctaccaccattttttgtgttttttagtagagacagggtttcactgtgttagccaggatggtctctatctcctgacctcgtgatccaccccgcctcggcctcccgaagtgctgggattacaggtgtgagccaccgcgcccggcccaaaagcactttttaaatgttgaggtggtttgaaggctaatggaaattacgaggtgggactgaaaccattccctgccatccctaagaaagcccactccttggaactgccactggtgaaagtctcactctgtcacccaggccagagtgcagtggcacaatctcagctcactgcaacctctgcctcccaggttcaagcgatcctcccacctcagccccgcaagttgctgggactacaggtgcccaccaccatgcctggctaatttttttttttttttttaagtagagacggggtttcaccgtattgcccaggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagtccagcctgggcaatatagtaagaccctgcctctaaaaaagaaaaaaaaaaggaccaagtattcttttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccaccgtgcccggccaggagcaagtattcttttaggtctaaaacaaaggtaactaagcaatactggtgtttgtttgttttgagacagggtctcactctgtcaaggcagacagctggaaacccacgtcaagaaaattgactattttcaaaagtcaatccttgcctcccaggttggagtacagtggtgtgatcatggctcacccaggagctcaacctcctgggctgaagtgatcctcctacctcagcctctctggtagctggaaccacaggtacacaccaccaggcatagctaatttttttattgtgtagagacagagtctcgctatgttgcctaggctaatctcgaactcctggactctatcgatcctcccatctcagcctcaaagtactgggattacaggcatgagccactgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaacagagtgggaacaagggtcttgaagaaggtgacatttgtttgggaacgagtgtctgactgcaatcaaaggaaaggccagtgtgacaggtggatgtaaatccacagtccattaaaatggccacagagagaaaacagacatattggccttccagggtgcaacatgagggcattcccttcctatgtacactggcaggcacctctccggtcccttggtccccagcaagatgctgagaaattgctgaggccaggggctccctggacacttatcaacacttatccttacccagggatagcgtttaagctcatgaatcctacgaaagctgaaccaatgcacatgtttatcatcttggaaccatttgatttgaggaaattgtaatagcacatgctggccaggcgcggtggctcatgcctgtaatcccagcactttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctcaaaaaaaaaaaaaatagcatgtgatagtgagatacacattttgcacagaaatgttggctgagatagtccaggagagtctctgtgagctgactttttacctagggtggaggagtggatggaagtggctgttcctacacacccacactgcctgtgcaaaaccgtgggctgcctgcaccacacacacaagcctgtttgattctcatacaaccccaagacaaaggtgtaatcccttttcaacagtgacagcactgaggctgagagcagcaaagtaggtcatagccagtcaatgggggtactgagatctgcattgagatctggctgtgtctaaagcgggttgtatcctctctgtgcttgcagaatggggctcgagggctcatctaaacccctcatcttatttatttatttttatttatttatttatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgcctttgtcgtggtctctgctgggtttccattaggctgcaactcaagctgctgatgcctccatttcatgtcgttttcacaaacattttgtaaagcagcagctctattattccagcagggcctgatcacctctccgcacccaacgctgataaaaatgacccgctttcccctatcgtcccagcgtgaaagaccaagatgctgaatgacacgggttggctttcttttccttccgaacattaatcaggttcttgaagataacatctctctctggaacgagccggcagcagcagagtttgatttccaggttcagccctaatggtacagagacctggactaatgtggcttattcaaagttccagccatgcttctaaagcatggcttattcgaacttccagctatgcttttaaagcactttgcatgaactattcacatgtcttttgaacaatatgatttaatggcattggaaaatcatcatgatgtcatgcttgcaatgagcaggacagctgtatgtcttgatccaatacacattaaaaatgcacctatccacacatatgtatctgtgaaaatgtcttcagctgcaagtaacacagcgtccgacgactagtgtcttaaatcttgggtgaccagctgtctctgtttgcctgggactgagaggtttccaaggatctggaaactgcagtgcagaaactgggacagccccaggcaaaccaagtcagttgttcacactacttaagtcataaggacatttaatatttacttgaggctggacacagtggctcacacctgtaatcccaacactttcggaggctgaggcaggtggatcacgaggtaaggagttcaagaccagcctggccaagatggtgaaactccatctctcctaaaaatacaaaaattagccaggcttggtggtggatgcctgtaatcccagctactcgggaagctgaggcagagaatggcttcaacctgtgaggcggaggttgcagtgagccgagatcatgccactgcactccagcctgggcaacagagctagactccgtctcaaaaaaaaaaattttttttgacttgataagcagtccagatgcaggtggcccgagggtcagtggggtggccccaggatgctatcaagggtctggctgtttcctttcctcccctctgccctagatagcgaacctgtccccttctgcccatgggtagtaagccaatcgctgttatgatggatttggcaaaagaaaagaatttattcacaccaacgcagccaagcaaggaggcaggagaaaaggtctcatacttgcctccctgaagatggaatttagggatctttatggaataaaggagcagggtggtctaaagtgtgggaagaggtgattggaggcaaggaaaagtgaggtcattggcaatctgcacatacatagccaagcttcctggatcttcatagggtgcatgtttagaaaatggcagcattagcatgatctcggggagttttgggccctctgacgtcaaaaggtcacttctccggcatttgcacaggttcagttgaagggtcattgatctcaacgggttcgaactggacaggagctgcccccatagtcctgaaaaacaactttaagcaaccattaccgtagtcacatatgtgtcgtagcgacatatatgtgacatatgacatatatgtaccataatgacatatagtgacatatgtaaggaagccggtgggggggttaggtatatatcatttggctgcttgacttttagctatataagttttaagaccagctagaagtaagtggttaaaagcaagcaaggcaagttaagtttggtgggcttcatcaggttagcgttcggtttcgccattctcacgtgagtggctgtaggagcttaggaccaggacaggggagaaccgaaggccctaattatccttcccagaagcctgcccaagcggagtttctcttaagggctttctctaagcccaccaaacttaacttgccttgcttgcttttaaccacttacttctagctgatcttaaaacttatatagctaaaagtcaagcagccaaatgatatttaactaaaccctccactggcttccttatatatgtcactatatgtcattatgttacatatatgtcatatgtcacctatatggcactatgacacatacgtgactatggtaatggttgcttaaagttgttctcttacatttcattggcccagagtagatgtcatagctacctccacttgcaagagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacacaaaaaaaatctcatgttttaaaaaggtttacaaatttgtgttgggctgccttcaaaagccatcctgggcctaatttggacaagcttgatttaggacctgatggtcctcctttagcggaaggtgtgtggaggaggtagagagagagagagaagagatgagacatgaggaaaacagagccatctcatagggacgttgatggagtcctgcagcgtgaatcccgtcagcagttctgtagagctccacctcgcttgtcaatgggttgtgggcttggatcttttgggaggattcaatgacatgctaagggcagccttggaggtggacaaagggccagggcaaaggcccccagggcatgcccgccacccttaggttacatggaggaaaaagattgctgtgaaatacaccagaaccctcggagtagaagtggcctctgctacacgtaggtcaaggttctgcatactttcatcttccttctttgtacttgtttgtattttccaaaatttctacaatgattagggatccattctataatcagataaaattgccatttacaaacttttattggccaggcatagtggctcatgcctgtaatcccagcactttgggaggctgaggtgggtggattgcttgagtccaggagtttgagaccagcctgggcaacatggcaaaaccccttctctaccaaaaatacaaaaaattctccaggtgtggtggcgcctccctgtagtcccagctactctggaggctgaggagggaggatggcttgagcccaggaggcagagattgcagtgagctgagattgtgccactgcattccagcctgggtgacagagccagactccatctcaaaataaaataaaataaaataaataaataaaaataaaaacttttacaaagaagagtataagcactgaaagttatttttaaaaaggttttacttgttagctccattcctcagaaatagtgcttcttccacatcattttctctttccttttttctctgctgcttttttttttttttttttttttgagacggagtctcgctctgttgccaggctggagtgcagtggcacgatctcagctcaccgcaatctctgcctcctgggttcaagtattctcctgcctcagcttcctgagtagctgggattacaggcgcccactaccaaccatgcccggctaatttttgtatttttagtagagacaggatttcaccaagttggccaggatggtcttgatctcttgaccttgtgacctgcccacctcagccttccaaactgctaggattacaggtgtgagccaccacgccggccattttttttttttttttttttttttttttgggagaaggagtctcactctgttggccaggctggagtgcagtggcatgatcttgactcactgcaacctctgcctcctgggttcaagcgattctcctgcttcagcctcctgagaactggggattacaggcatgtgccaccacacctggctaatttttatatttttagtagagaaagggtctcaccacgttggccaggctggtcttgaactcctgacttcaagtgatccttccacctcggcctcccaaagtgctgggattacaggtgtgagccaccccacccagccattctctgcttctttctcacagctaatgataataatagtaaaggccaagggtggtggctcatgcctgtaatcccagtgctttgggaggctgacatgggaggatcgcttgaggctaggagttctagaccatcttggccaacatggcaagattctgtctctacaaaaaatttaaaaattagctgagtgtaggggcatatgcctaaagtcctagctacttggaaggctgaggcaggcaaatccttttacccctggcgttcgaagctgcagtgagctatgattgcactgctgaactccagcctgggtgatagagctagaccctgtctctaaaaaacataataatagtagatagcatttactgggcatttgactgtgtaggtcccaggcactgtgcttaatgcttgatgtgcataataatcccagcaaatagtactgccattattcctatttaaaacatgacggctaggtgcggtggctcacgcctatcatcccagcactttgggaagctgaggcaggtggatcacctgagatcaggtgttcgagaccagcctgatcaacatggtgaaatctcgtccaaaaaaaaaaaaattagctgggcctggtggtgcatgcctgtaatctcagctacttggaaggcttaggtaggagaatcacttgaacccgggaggcaaaggttgcaatgagccaagatcgcgccattgcactccagcctaggcaacgagagcaaaactctttttcaaaaaaaaaaaaaaaaacataaataaataattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatccaagattcctcaacttcagtgtgattgacatggtggctggctcactttctgttgtgggagctgttctgtgcacagtaggatgtttagcagtgtccctggtctctacccactagatgccagtagcaaccacacccctccccaacacacactcaattataataaccaaatatgtctccaggcattgccaaatgttcctggggaccaagattgccctgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcctgctgtggtttgtatgtctgtctcctccaaatctcatgttgaaattagtctgttctcgcatttctataaagaactacctgaggccgggcgcagtggctcacgcctgtaatcccagcactttgggaggctgaagtgggtggattgcttgagccaaggagttggcaaccagcttgggcaacatggtgtaactctatctctattataaagaaacaaaaaaatttttttttgggacggagactcgctctgttgcccagtgcagtggcgcaatcttggcccgctgcaacctccgcctcctgggttcacacattctcctgcctcagcctcccgagtagctgggactacaggtgcctaccaccacgcccggctaatttttcgtatttttagtagagacggggtttcaccatgttagacaggatggtctcgatctcctgacctcgtgatctgcccacctcggcctcccaaagtgctgggattacaggtatgagccaccgtgcccagccagaaaaaaaaatttttaaacaggctacctcagattgggtaatttatacagaaaagaagtttaattgacttgcagttccactggctgtacaggaagcatggctggggaggcctcaggaaacttacaatcatgatggaaggcgaaggggaagtcttacgtggctggagaaggaacaagagagcaaagagggaggtgctacacacacttaaacaaccagatctcgtgagaactcactatcatgagaacagcaagggagacgtccacccccatgatccaatcacctccccccaggcccctcctccaacactggggattatgatttgacatgagatgtgggcagggacacagatccaaactacatcataggccccagtgggaggtgtttgggtcacgggggtggatcccccatgaatagattaagctcttcctgggaggtgggggtgagtgagttctcactcttttagttcctggacagctggttgttaaaaaaagcctggcacctccccctctctcttgcttccactcttgccctgtgacttctgcacacatgagctccctttcaccttctatgaatgtagccagcctgaggcccatgccaaatgtcccatcttccagccagcagaatcatgagccaaataaacctcttgtctttataaagatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaaaaagcactcagccacaggcattccttgatagcaacactcaggggactaagatagggccccatgctggtatacagatggcactgctgaaaggagtcagcagccccggcccttgatggagacgctgaggaacgaggcagaaagatcagtggactcagactccgaagggtcgatttctagttctggtcctgcccccatgagctgtgtgtactcagttgagcctctttacctgtttccgcatgagtaaaatgaaaatatgatttctgtcctctggtttttcctaggatagttgtcaggagcaaagtaagatactggctccaagctgacccactacatcccttacctgcttcagtcttctttgtaacatctgaaatattgtatttgggtttaccttctgtctctgctagcaaaatgtcatcttcctgagggcttggtcttctttgctgttgcaagcctcagagatgacaacaatgcccaacatagtagatgttcaataaagacgtgcaggccaggtacagtggctcacgcctgtaatcccagcactttggaaggccaaggcgggaggatcacttgaggccaggagttcaagaccaacctggtaaacagcaagaccccatctctatgaaaattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgtaagtgttcatgccactagacccagcaattgcatttctatgaatctatcctagaaatgtattaggaaacaacccagatgtctatgaataggggaatagttaaataaattatagttaaatagatcactgtataatcagctgagtgcagtggctcacgcctgtaatcccagctactagctactctggaggctgaagccagagaatcacttgaacctgggaggcagaggttgcggtgagccaagatcacaccactgcactccagcctgggtgatacagtgagactgtctaaaaaaaataaaaataaaaataaatttaaaaaataaaaatagatgactgtatatcaatataatggtatactatgcagccactaaatatgtggagatttgcatatactgatatggaaagatgatcaagactattaaagattattaaattgaaaaaagcaaattgcaaaaaatttttgtgcaataacaatggtgtcatatatgatattataagcatacgctttttttttaaatctggaggaggctgggtgcagtggctcatacctatatcccagcactttgagaggctgaggtgggaggattgcttgaagccaggaatccaagaccagccgggcaacataacgaggtccctctctctacaaaaaactgtttaaaaattagcctgtagtcccagctactccgtagggggctggggttgggaggggttgtgcagaggtgggaggatcccttgagcccaggagttcaagtctgcagtaagctatgatcacgccactgcactccatcctgggcaacagagcgacactctatctccaaaaataaaaaataaaaaattaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgatggccaggcaccgcggcttatgcctgtaatcccagcactttgggaggctgaggtgtgcagatcacttgaggccaggagtttaagaccagcctggccaccatggtgaaaccctgtctctactaaaaatactactaaaaatacaaaaaaagttagctgggcatggtggcaggcacctataatcccagttacttgggaggctgaggcaggagaatcgcttgaacccggaaggtggaggttgcggtgagccgagatcatgccactgcactccagcctgggcaacagagtgagactctgtcacaaacaaacaaacaaacaaaaaacagtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacacaacttcgagtcaggaagacctgggttcaagtcctagtgaattctggtcaccttcttgtccttggacaagtcactgtacttctctgagactcaatttctcctcctctgaaaattggctagtaatagtaagagggtctaattcattgagtataaatatcctaaagaggctgggcacggtggctaatgcctgtaatcccagcactttaggaggctgagatgggtggcttacttgaggtcaggagtttgaggccagcctggccaacatggcaaaaccccatctctactaaaaatacaaaaattagccaggtgtggtggcacacacctgtaatcccaggtaaccggcaggctgaggcaggagaatcacttgagcttgggaggtggaggttgcagtgagctgagattgtgccattgcactccagcctgggcaacacagcgagacactgtctcaaaaaaatatataattaaattaaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaaaaaattttcccctgcccatcaggctgtgttagttgccctctgtggggcttacccttatcaaaatgctagtcccaggccaggcatggtggctcacgcctgtaatcccagcagtttaggaggctgagagggcagatcacttgagttcaggagtttgagaacagcctggcaaacatggtgaaaccccatctctagtaaaaatatgaaaattagccaggggtggtggcgggtgcctgtaattccagctactcaggaggctgaggtgggagaattgcttgaacccaggaggtggaggttgcagtgaggtgagatctcaccactgcacttcagcctgggtgacagagcgagactccgactcaaaaaaaagaaagagagaactgagtaatttataaagaaaataagtttaattggctcacagtcctgcaggctgtaccagaagcatgatgctggtgtctgctcagctgctggaaggcctcaggaaacttataatcatggcggaagacaagggagcagacatgtcacgtgcccagagcaggagcaagagagtgaggcgggaggtgccacacacttttaaaagaccaaatctcatgagaactcactatcacaaggacagtaccaaggaggatggggctaaaccatcatgagaaacctccatcatgatccaatcacctctcatcaggccacgcctccaacactgggtattacatttcaatatgagatttgggcggggacacacatccaaactatatcagaatggatgctgctgattggttggggatgcaatcataggtgtgtgaaaaatgattctcaggggtgctaagtccacttctgggtggcaggtccacgtggatcatcattcatcagaaatgcaaaacctaaagagatatctcaaaaggctgatcttagattctgcaatagtgatgttatctgcaggagtaattggggaagttgcaaatcttgtgacctctggaataatggcagtagtcatttatgtctacaccttagcagaattcagcctcctcccatccttctaacatgggggccttttattagctttacaaaggcagtttagttggtggaaaaggttataatcatttaaactataaactaaatgtctcccaaagctagcatggcctaaacctgggaatgattaagggcagcttggaggttaaaggcaagatgggggttggttagatcagatccctttcactgtcctaattttctcactgttatcatttttgcaaaggtgttttcaaataggccagataagcacccaccattacccttgacttgaatgtttttgccatgctgtcagttcaataactatgtcccaagaggctgttctgcagcaagctctgaacctaggagccgggcttgcagtgatgaacagagaacggttctccactctcaaggagcccccaggttagcagaaagagactgggcccagcacacagtgggtgcccataagtggcagttcttactgagctacaagtgcagcatgatgagccttaaagcagcgtttcccaaccttcaactattgacatttggggttgacaaatgtcagtatcttcctttggggttgatcattttttgttgggggtacggggctctgtgttgtgtcttgtgggatgttgagtttcatccctggcctctacccactacaggccattagcacaacgtacctctccgctacccctcaatggtgatgttacctgaaagggatcctgatccagaccccaaagttcttggaccaagagcaagaaagaatttagggcgagtccgtaaagtgaaagcaagtttattaagaaagcaaaggaataaaagaatggctactctgtaggcagggtagcagcttgggctcctcgattgattgtacttatagctatttcttgattatatgctaaacaaggggtagattattcatgagttttctgggaaaggggtgggcaattcccacaactgagggttcctcccctttttagaccatgtagggtaacttcctgatgttgccatgacatttgtaaactgtcatggcactgatgggagtacctcttagcatgctaataccttataattagcatataatgagtagtgaggacgaccagaggtcactttcatcgccatcttggctttggtgggttttggcagccttctttactaatgctgttttatcaggaaggtctttgtgacctgtatcttgtgccgacctcctatctcatcttgtgacttagaatgcctaacctcctgggcattcagcccagtaggtctcagccttattttacccagcccctattcaagatggagtcactgtagttcaaacccttctgacagtgacaaccaaaaatgtctatagatgtacagatgttgctgaatgtaccccaagcgaggtcaggggggtgtgcaacattgccctatgaaaggaaaataaagtcccaggaccccaattcactataccaaaaggaaaagttaagcttgggaactatgagtcatacaaaaacctacttttttttttttttttgagacggagtctcgctctgtcccccaggctggagtgcagtggcgcgatctctgctcacagcaagttccgcctcccgggttcatgcctcagcctcagtctcccgagtagctgggagcctgtaggcacctgccaccacgcccggctaattttttgtatttttagtagaggtggggtttcaccgtgttagccaggatggtctcgatctcctgacctcatgatccacccacctcaagcctcccaaagtgctaggattacaggtgtgagccaccacacccagccaaaactgcctttctttttttcctaaacagatagctgcaagatagaaaggccacctatcttcccaggggcctccctcaccctgtcaatgtaaattaacagcttatcctaacaggtaggggactaagacaagactataaatcatcgtccctccgcccacccggagacaaatgcacatttgacttcctcctctactccgcgtttcctttatcctatgtaaaatgcaaattcactgagggccagagaatgcaatcctccccttcctgccctctctttcccctttaaatattgaagtccttaagatcctctgcagaaaaaagcacaggccggggatcctattgctgcctgtgtctctttttcccaggtgcctcctcgactttggcaaaataaacctccagattgattgagaccttctcagacactttgcagcttacagctcccacataagaactactactttagtaattagagtgcagcaatctgggtttgaattcagccttagcaggcaggtgaacttcgtgaaagttcgcgacttaatttctctgagccttgaattccttgttgggaaaatgaggccaataatactaccccccgcatggttgttgtgaatatcccataaataacaaaggcaaggtgtaggagtcttccacacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtgattaaaatgttctaaaatggattgtggtgatggttgcacaactctgcaaatacacttggaacagatgaactgcatggtatgtgaatcatattgcaataaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttgtgatatggtttggctgtgttcccacccaaatctcatcttgaattgtagctcctataatccccgtgtgttgtgggagggacccagtaggagatgattgaatcatgggggacagtttcccccatactattctcatggtagtgaagaagtctcatgagagctgatggttttataaggggtttcccctttcgcttgattctcattttctgtgctgcctgctgccaagtaagacgtgccttttgccttctgccgtgattgtgaggcctccccagccacgtggaactgtgagtccattaaacctctttttctttataaattacccagttgcgggtatgtttttatcagcagcgtgaaaatggactaatacaactagggtctgctttcctggcacagtaagaccagctgtctccccagagtttttgcagtggtaaaaaggaaacagtttatttgcaaggctccaagccaggaggactgggcagctaatgcttcaagcctgacctcctcaatggcttataggtaatgttctgtccaacaggttcaccttgccctctgcctagacaaacctgacttatcaagactggggaattacaatagagaaagagtaattcatgcatagccggctgagggagactggagttttattattcctcaaatcagtgcccctgagcattccaggatcagagtttttaaagacgatttggtggatgggggtgggggtgcagtgagaatggagtgctgattggttgggtcggagatgaaatcacagggagccgaagctgtcctcttgcactgagtcagttcctgggttggggccacaaggtcagatgagccactttatctgggtggtacccactgacccatcaagtgcacggtctgcaaaatacctcaagcattgatcttggtttttacaatagtggtgttatcttcaggagtaatctggggagggtcagcatcttgtagcctccagctgcatgattcctaaaccataattcctaatcttgtgcttaatttgttaagtccattttcacactgctgtcaagaactgcccaagactgggtataacggaaagaggtttcattgactcacagttcggcatagctggggaagcctcaggaaacttacaatcatggtggaaggtcaaggagaagcaaggcactctcttcacaaggtgacaggaaggagaatgaacgcaggaggaactgcccaacccttataaaaccatcagatctcatggaactcactcactatcataattcctaatcttctggttaatttgttaagtccattttcacactgctgtcaagaactgcccaagactgggtataaaggaaagaggtttcattgactcacagttcggcatagctggggaagcctcaggaaacttacaatcatggtggaaggtgaaggagaagcaaggcactctcttcacaaggtgacaggaaggagaatgaacgcaggaggaactgcccaacccttataaaaccatcagatctcatgggaactcgctcactatcacgagaacagcatggggaaactgcctgcgtgattcagtcacctccacctggtctctcctttgacacgtggggatgatggggattataattcaagatgagttttgggtggcgacacaaagcctaaccgtatcacctacaaatgcagtctagttcccaggcaagaagggagtttgttttgggaaaaggctgttatcgtctttgttttaaatgataaagtaagttcctcccatagttagttcagcctatgcccagtaatgaacaaggacagcttggaggttagaagcaagatggagttgattaggtcagatctctttcactgtctcttataattttgcaatggcgatttcagtgcaggtttttaaaggcaggggtaaatttcagtcaagcagaagttacaggcaaaattgtaaatcaatacattgagattacatatcaattttggcctaaaagggctgcatacgttgaagctggggctcacaggtcataggtagattgaaagattttctaatttgcaattggttaaggaagagaagctttgtttaaaaatcgggggtcaaggccaggtgcagtggctcacgcgtataatcccagcaccctgggaggccgaagtgggcagattgcttgaggccaagagttggagaccagcctggccaacatggcgagacccccgtctctactaaaattacaaaaattagccgcgtgtggtggcgcctgcctgtacttccagctactcgggagactgaggcaggagaattgcttgaactcgggagaggggggttgcagtgagccaagattgtgccactgcactccagcctgggcgacaaagcaagactctgcctcaaataaataaataaataaaaataataaaaatcgggggtcagcagaaaagaatggcatccctggcccatgggtgtgactccctccaggcctctctggaagacacttagaacaaggaaagatggtcagaattcagtccttagtcttcctttatctgacgtctatatgccagtggatccatttggtagggtcctgggtttctgaaaaacaactcagacatatatgctaagatgtttatcttcagtttctatagaaaacaaaacatctccagattctaacttccttggctattgttttaggctactattaccttcttactgataagttgcttattgacttttcaaggctagctaggtgcctagaatttcctttgagggaactcaagattttcctttatttccatgcttggggtgggggtctcccacagaccccaaaagggagtccctgtgttactggtggaaggtgtccaggttcttggtgttttgaacaaagaattggacaaaatgcacacacaaacaaaataagcgaggaaagaatgaagcaacaaaagcagaaatttattgaaaatgaaagtacactccatagggtgggagtgtgcctgagcataggggctcaggagccccaatacagaattttctgaggtttaaataccctctagaggtttcccgttggctacttggtgtacaccctatgtaaatgaagtagtggcccacaattagtctgattggtcgcagaaagcttttgcagttgctttctgcgaccaatcagatatactttcaatttctcatgtgacacacagaaaaggaggagggtttgcaaagggagtagcctccagtccttttgttacttatgtgtggaaagttggggtttttcttttgatttagttctaggaagttggccctaggttccctgcctccagaccatattctcctgcctcacctgatccatctcagcattagtaatttttttttttttttttttgagacagagtcttgctctgtcacccaggctggagtgcagtggcgagatctgggttcactgcagtctccgcctccggggttcaagtgaagtgattctcctgcctcagcctcctgagtagctgggactacaggcgcccgccaccatgcccggcaaattttgtttttgtatttttagtagagactgggtttcactgtgttagccaggatggtctcaacctcctgatctcgtgatctgcccgcctcggcctaccaaagtgctggaattacaggtgtgagccaccgcgcctagccgagcattggcaatttttaaagctttgcacctgattgtgataagcagggacggttaggaaccgccaggcctgttcccctctctcatttcacaattctccaaggattagtctggctgaaaggtacagaaacccatccaagcttatgtaagcacaaaacaaacaattactggaaggacagtggagtctcctgaagccctagggcattacattcatttcccagagctgcctaacaaattggtgcaaactggatggcttaagcaacagaaatgtattctctctcggttctggatgtattctctttcggttctggaggccagacatccaaaatcgaggtgtcaacagggccttgttccctgctaaggctctagaggagactcctttgcctcttagcttctggtagtgttagtgaagtagtgttgttgactggggtaaatacccaaggttcgttgtctctctccaagcagattaaggacacagacactgacatacagaggagtgagtttaggagtggaggtttaataggcaaaagaaagagaaaagggaacagctctctcggtctctctcgagaagtccctgaatgggaattccggcctgtggcagactgcaccaaattttatagacaagcttgaggaggtggtgtctgatttacatagggcccacagattggttggagcaggtgtgacgtttgcatagtgcatgggaaggctggccaccccaccctaatcttatcatgcaaatgaactttccacttgggcggcgccatgttgtcttctccttactgtacacatggctggcaaagagaagggagcgtggagccgccattttgaacatacctagaccaggtggccttttcctatgggcacagctgccagcattcacccgtgtaagcttccagctcccttgactatgtctacagctcgattttactggctgctccttgttagaaaagaaaatgatttgggggttgcttttcattaaaaggaaaaccttaccgaggacttccttaccctatctgcctaaataatttcttcttcactcctgtatcattagcagtagcaaatccatacgagtctgaagcaacttgatacttgcctcctcagaggaaataattccaccagcgggcataaggcagagtgagagaccgaggcaagttttagagaaggagcaaaagtttattaacaagttttagagcaggaatgaaaggcagtaaaggacacttggaagacggccaagtgggtgatttgagagatccaagtgcaccgcttgacctttgatttggggttttatatgttggcatgttccggggttttatatgttggcatattccagggttttatgtctctcctcccttcattttccctcagggcaggttgtgcgcatgcgcagtggcctgccagcgcttgggagaggctgcaaacacagtgtatttacagaagtcatgggcctgattatttgagatgtttttccctcaccagttgagtgttcctagaggaaggtcatataccagttagactccgccattttgcctcttaatgtgcatgcttgagcccagttgcccaactcctgagatctcatcgggaaaccgctgataacttcaggtgttttctgtctgttgggagatggcctttccctggcaccagctgtgaccaattattattttagagagacaattttaacaactgcctgacatcacctgatggttgcctggcattccttgggggggaaatcccctctcctttcttgctcatggctgcctggctacctactctaacagtaacacacacaattcttggcattgcttgccttctggttgcaccacttcaatctctgcctccatcttcacgtgaccctgtgtgtgtctgtgtgtcttctcttctcctctttttttttttttttttctaaaagacagggtctggctgtgttgcccaggctggtctagaactcccaggcttaagtgatcctcctgcttcagcctcccaagtagctgggattacaggttcaggccaccatgcttgggtctctttcctcttctcataaggacacaagtcattgggtttagggtccatgctaataagtatgacctcattttagcttaactattataattacatgtgcaaagcaacttacaaattactttggaaatagagtatttccaaatagaagagatataaactggggaaaactatttccaaatagggcacacatgaactttgggggtgccttagtctctgtggcttgctctagaccgggggcttgtaaacaacatttattacagttctggaggctgggaggtgcaagatcaaggtgttggcagatacagtgcctggtgacggcctgttccttatagatggtaccttctcactgtgcctttgtgtggtggaaggggcaaacaagctcccttgggtctcttttataagggcactaattccattcatgagggttctaccttcataatctactcacttcccaaaggcctcatttcttaatactatgaccatggaggttaggatttcagtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgcatttcaaaattgtatgcaatttagtatgcaggatgtgcaggtttattacataggtaaacgtgggccatggtggcttgctgcacctgtcagcccgacacataggtattaagcccagcatgcattagctatttttcctgatgctctccctccccacactcaccctgccctctcaatttttttttttttttttaagagacagggtctttctctgttacccaggctggagtgcaatggtgcaatcataactcactgcagcctagaactcctgggctcaagagatccacccacctcagcctcccaagtagctgagactacaggaacactccatcacatgtggctaatttacagagaaaatttttgtagacataggagggtctcactatgttgcccaggctggtcttgaactcctggcctcaagtgatcctcctgccttggtctcccaaagtgctgggattacaggtggcaggcactatgcccagcccattactcccattttaagcctcactgtgtattttacagatgagaaaactgaagcttgaagaggtcaagttgcttctccaagttcatccagagggtggaagggcagagtcaggtctccaatcaatcctggccgctcagctcaagtgcttttttttttttttttgagacagagtctcgctctatcacccaggctagagtgcagtggtgcgatctcagctcactgcaagctccacctcccgggttcatgtcattctcctgcctcagcctcccgagtagctgggactacaggcacccgccaccacacccggcgaattttttgtatttagtagagacggggttccaccctgttagccaggatggtctcgatctcctgacctcgtgatccgcccaccttggcctcccaaagtgctgggattacaggtgtgagccaccgcacccggccagctcaagtgcttttagtggtcaccctctcatctgtctctctgtaattttttgttttttttttctttcttgaaatgaagtctcattctgttgcccaggctggagtgcagtggcgcagtctcagctcactgcaacctccgcctcccaggttcaagcaattctcccgcctcccgaggtggtggctgacagcctcccgagtagctggaattccaggtgtgtgccaccacgcctggctaatttttgtatttttggtagagatggggttgtttcaccatgttgaccaggctggtctgaaactcctgacctcaagtgatccgcccacctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataatacatggcagagcttccttcacatcctgtcactcctgaaggcaatgtcttgaaacttctgctatcagtttctaccgaaactctgccacctgaactgacttgctcccaacctctgtcctcccaacctcccagctttgttctcccctttcccttccccttagtggcgccaatgcccttttctaagtatcagggtcttctctttgcatctgctgccttgacctcgacaaccacagccctggagctgcagtgtaaaaacatgttgtaaatgttgaaaatgtggaaagctgtacatgttggttcttgatttttgtttccttacaccagagcaaagcttttagggcctttcacaaggaaaaaggcccttccaacccagagggcaacttgctctttattgtctgtgttctcagagacctttcttcaagggtcctgggactagcagttccactgcccttcttcatgctgcaatggacttctggttaatgagagaaaccaacttttccctcctatccaaatattatattctatggtcgggtacagtggctgacgcctgtaatcccagcgcttctgggaggccaaggtgggtggatcacctgaggtcaggagttcaagaccagcctgggcaacatggtgaaaccccgtctctactaaaactacagaaattagccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccaggcccacagtggatcacgcctgtaatcccagcactatgagaggccaaggtgggtggatcacctgaggtcaggagttcgagaccagcctggtcaacatggtgaaaccccgtatctaccaaaaatataaaaattagctgggcacggtggcacacacctgaaatcccagctactcgagaggctgaggcaggagaattgcttgaacccgggaggtgggggttgcagtgagctgagattgggccactgcactccagcctgggtgacagggtaagactttgtctcaaaaaaaaaaaaaaaaaaaaaggccatttcagagaagtctgggagccataaggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtcaagaaactgtcttttctttgttgacccagcgtttctcaaatgtgtttaactgctgtattagtgaggcctctttcagttagaagaaatggatgcctggctgggcgcggtggctcacgcctgtaatgccagcactttgggaggccgaggcgggcggatcacaggtcaggagatcgacaccatcctggctaacacggtgaagccccgtctctactaaaaatacaaaaaattagccgggcttggtggtgggcgcctgtattcccagctactcgggaagctgaggcaggagaatggcgtgaactggggaggcggagcttgcagtgagccgagatcacaccactacactccagcctgggtgacacagcaagactccatctcaaaaaaaaaaaaaagaaagaaagaaaagaaatggatgcccaattcaaactggtctaagcaaaaaaaggaatttgttggagaaagagcaacaagaactagagcctcaaggactgaacactattacctcccctccttttcttctttttctcatctctgcctctctttgcatgtaagcatcattttttcctacaacacaggccttctccatgggaccagaaccctagaaccatagcttagcaactctgaagcaataccacaggttcttttccctggtatcgaaatacataagtctcagggaaatattctcacccgcccttctgggattatgttcccacctcttagatccattaccatcaccaagaggctgggggtactgggattggccaggaatgtataacatgcccactcctgcagccacagggacatgagctgttagaggaagagggacttgaaatcttgctgggaagacaaaaaccaaaagctgccactgtctataaaactacaaacccagttttcattaacatcctgtgaaagatggttggagggagtaaggaaagagaagggcaatgatctcttctgctggctcctataaccacaaggcacgtgatcactgccgaaggccagcatcctcagtggaccctttcatgaaaggcaaggtagaaaaactccacttagcagcatggaggaggagcaaggaaacttgccttctctattggattatgggtggaaaaaagaaatgattctggcgagaaatcaaaacaccaagcatgcaccacatgcaaggggccaactttacactactcatctggtactggaattccaagttgaaaaataaaaactattgtaaaaccagtgaaatctctgggatcctagcagatttagcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgcttgaacccaggatgcggaggttgcagtgagccaagatcacaccactgcactccagcctgggtgacagagcgagactccatctcaagaaaagaaaagaaaagaaaaacccatgaagaactgaatcaccatgaggagaatcagtagatgcaccaaagagaatgtcctcccaagaaccaaaaatatagaactatttaaaaaggaaaataaactaagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatcatgccaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctacttgggaggctaaggcaggagaatcacttgaacccaggaggcagacgttgcggtgagccgagatcgtgccattgcactccagcctgggtgacagagcaagactccatctcaaaaaaaaacaaaaaaagtgtcttgggccaggcgctgaggcgggaggattgcttgagtccaggagttcgagaccagcctgggcaacatggcaaaaccctgtctctactaaaaatacaaatagctgggcatatgcggtggcgcgggcctgtgatcccagctacttgggaggtgggaggattgctggagcctgggaggttccagctgcagtgagccatgatcacaccactgtattccagcctgggcaacagagcaagatcgcaccccctggaaaaaaaaaatagtgtcttgataaacatctagggggataaggtttcatctgaattttttattttttccttaagataaactcctagaagtaaaattattgggccattcataagtagcattttcaaaatatttgtaaattggctgggtgcggtggctcgcatctgtaatcccagcacgtcgggaggcagaggcaggctgatcacttgaggccaggagttcgcgaccagcctggccaatacagagaaaccccatctctaccaaaaaatacaaaaattagctgggtgtggtgacttgtgcctgtaatcccagctactcaagaagctgaggcaggagaatctcttgaacatgggaagcagaggttacactgagctgagattgcgccactgcactccagcctgggtgacacagcgagacttcgtctcgaaaaaaaaaaaaaaatttgtagatcaaaaggtctttggttggacaggccctcccagcaggctgctagaccccagtcctcccactctgcgtgttcgcggctttggtctgcacaccacttcccaccattctgatgctgaaaagggtcccttgggctactcagtgccaccacaatggcctcagaggaccccgtgtcctccttcaccaacctagaccaatcatgaagccagactcttcgtgtactggggatgccataatgaatgaccttctactgggtgacttaaaacagtggaaccgtctcctttcacagtcctaaaggccagaagcctgaaatcaacctgtctgcggtgctctgctccctctgtggggaagaatcttcttttgcctcttgcagctcctggtggctcctggcaccttggcagttccctggctgcaccactccagtcttcacctctgtctccacgtggccgcctccgctgtatatgtgcctctgtgcaccctctcatcttaaaaagacaccagtcattggagtgagggccacccgaatgcagtatgatctcatttggaccctttccttaattacttctgcaaaaaccctctttccaaccaaggtcacattctgaggctccacgtagacatgcatttggggaggacccaattccacccaccacagacccctcccgctccaacgtgcagtgaaaactcaggctgcaaagggcccaccgccctcttttccccataaaaaatgtgggtcaaggctgggcactgtggatcatgcctgtaatcccagcactttgggaggccgaggtgggaggctcacttgaggtcaggagctcatgaccaacttggctaacatggtgaaaccccatgtctactaaaaatacaaaaattagcaagtgtggtggcacatgcttgtaatcccagctactcgggaggctaaggcaggagaatcggttgaaaccaggaggcggaggttgcaaagagccgagatcgcaccattgcactccagcctgggcaacagagtgagactccatctcggaaaaaaaaaagggggggcttggggggtccgggcgtggtggctcaagcctgtaatcccagcactttgggaggccgaggcgggcggatcacgagttcaggagatcgagaccatcctggctaacacggtgaaaccccatctctactacaaatacaaaaaattagccgggcgtggtggtggacgcctgtagtcccagctactcaggaggctgaggcaggaaaatggcgtgaacccgggaggcggagcttgcagtgagcagagcttgcggtgagcagagattgtgccactgcactccagcctgggcgacagagcgagactccatctcaaaaaaaaaggggagaggggagtgggggggtcagcgaggtctgacctcaggccagttatacagcagtcactcacagatccaacgaaccagaggagatcaaaccctcatcaaaatcctgcctctggtacttccgctaagctctgggtacacctactgtatgttcctgtaattcctactgatttttttaaaaaaagaaaacattaaaaaatccaatttatttaagctgtcacagacgcttccagattaccagggccaccttccaagctgggaaaccttgcagactgtggggtcctgcacacctagacttgctccttttagaagccatggaggaggttgataatgggaataacatttattgtagcttatctctatgccttgagcaatgtgctcacactggctggttccctcctcacatcagcctgatgagtcagatcctgttattacttctcactttacagatgaggaagtagcagtaaatccattacccttttcaagcggaggttgcaagaggttgcaagcggaggcagaataaacacttgaaacagtgagtcagatcctgttatcacttctcactttacagatgaggaagtggcagtaaatccactgcccacggtcccaggggttgttagtgacagagtcatcattcatctccctccctccccaccactgtagccccaattgttctttctcttcccatcggagggatttaaacaggtctctcccatttaaaagcaaacagggctggacacggtggctcacgcctgtaatcccagcactttgggaggccgaggcgggcaaatcacgagatcaggagattgagaccatcctggctaacatggtgaaaacccatctgtactaaaaatacaaaaaaattacctgggcatggtggtgggcgcctgtggtcccagctacttgggaggctgaggcaggagaatcgcttgaacctgggaggcagaggttgcagtgagccgagattgcgccactgcactccagtctggagacacagcaagactttgtctcaaaacacacacacacacacacacacacacacacacacaacacaacacaacaacaacaacaacaaaaaaagtgtcctcttccttttagagaatttaaaaaacagggtgaaaccccatgtctactaaaaatacaaaaattagcaagtgtggtggcacatgcttgtaatcccagctacccggaaggctaaggcaggagaatcggttgaaaccaggaggcggaggttgcaaagagccgagatcgcaccattgcactccagcctgggcaacagagtgagactccatctcggaaaaaaaaagtgggggcttgggggttccgggcatggttgactgtgtgactatattatatctatacataatatatagatatatatctatatataatatatagatatctatatattatatatagatatatatctctattatatataatagatatatctatttatatatagatattatagagacatctatatctatatctatatataatatctatattatattacgcctgtaatccccgcactttgggaggccgaggcaagtgaaccacttgaggccaggagtttgagacgagccagagcaacatggcaaaaccccgtctcaaaaaaaattagccaggtgtggtggcagcatctgtaatcccagctgttcggaggctgaggcatgagaatcgcttgaacccggtaggaggttgcagtgagccgagatcgtgccactgcaccccagtctgggcgatagagtgagactctgtctcaaaaaaaaaaaaaatgtatttcctgattcttgccacacctgcccttgatgcatcagactctggctgctgaaataccaagggcggcgaccctgcagccccagtgtggatttgtctgcacttgctgataccagaaactgcagtgggggcaggtgggtggtaggagcgggggttccctcatgcccaggccctgcacctgggaagcctttggaggccatcacatgagctgcctgaggcggatggaagagacggtgccaagcaggcccaatatgttccctgctggccctggtactgctcccctgcggatgctcctggttggttcaccacctcgtgcggagtgaggagctgagcagcccagccactgagcaggatttccctctaagaacggccccttccaccctgcaatgccttcttcctctgcacctcagctcccccacttccaaggcgttccttcccggaacgtgtgtattcttctcttcatcttgctaaggaaagttctggctcttggtgctctggcttggcaccttctaagctctctagcccttttccccccgccccccccccccccaaaaaaaagcgttctcagccaggcgtggtggctcatgcctgtaattccagcactttgggaggctgagcccagaggatcacttgagctcaggagttcaaaactagcctggccaacatggtgaaacctcatctctactaaaaatacaaaaatttgccagtgtgatggtgcacatatgtaatcccagctactcgggaggctgagacaggacaatcgcttgaacctgggaggtggaggttgcagtgagctgagattatgccactgcactccagcctgggtgacagagtgagactgtctcaaaaaaccaaaaaacaaaacaaaaaaccactcaggcttagccatttctctggggtcttcatttccttatgaagactctcgcaaaactggtatgaagtaaaatttgtttgcttttttcctattaatgtctttgtcagtttaaggcccagccagggacactaggagaattgaggaagttttgccgcccaccgcccccccccccagcaatggggacagcaggtgggtggaggccgctgagggcttctgcgccatgactcaccctctgcccatggaagcagctagaaagtgaaggtgaatcccaaagcgcaacgctccttctggcaaagggaacagagagggaacagatcttcttcaatcagcgcagccccctctgctacggacaggtctgctctcccccagacagctgtcttctaggcccccacctctgaatcaccttcctaggtgggaaacaaacaaagataaatgcaaagccaccgttccagccccagtccacacctaacaagacctcctgacgccgctcaaaaggggcacgatggctactcaactttttctgcacaaatttgccatcgtgaaatgtttggaaaggtctttagcagcttttaacattgctgaacttgaaaaaaatgtcatcaagaagcaatttactcaagtctcttctgggtccttttaaattcttgccagagggtgctggtggcaggggtgacggggtaatggcggtctcaggggatgggagggcttcacaactgtatctgtggaataactcttttccaaattggcttattcaaaaagcatgcttagcagtgaccaaaaacgagacagcgggcacgctggatttctttcacaagaagagagagcctaggaattaatagagttttctaactggaaggtttttgtggttactgtattttcccacatgtaattataagctggaacaaaggctggaaaacttggaggatcctgacgacgaagggcccaccatccagccacctgcttcggcgtgtgctgagtttaaaaggcctctaagatgtagacggatttactctccacctcacaattctatttccagaaggggagagaagttgaggagacccaaaatgaaagatggcagaactgtattggtttgtaattcctccccacagacagacagacagacaaaaccactcacttgggaaactcaaaatagatgctcgcttgtaaagtttattgacaactgtttggtcccaacacacaaaacagcacttgaaccacaacaaaagtgttcaaacaaagtagacaactaagaaaaacatctctttcccccaaacccaatccaaaacaaacagtgcaagatgggaaagggggttttggtgataacttttgtcatttttttaaacagataaatttaatccggtatatctttccacccagaaataaagaattacattgtcttaatgctcaaacatcattttaccacatcatttaattaagcctctggataaaaaaatagatagcaattggactggccattgtggagtacattatgaacacaatgtgcttccgaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggttttaaagtccaccactctttacatgctagcagaactgaagtccaagcgtgcaaactcagccttatgaaatcttagaataaggcaactgatgttctcaacaccaattattattactttgtttaaaagctcctttaaaaaaaattgcacatttgcatttcacttcctgtaacactatgtctgtagaggaaatgccttcaggaggattcggagagtgccataatacttacagggttttttccatggtgttctgtcttgactggggccatgtgttgagaactgggagtcactggcttcatttaaaagatttggggaacaaaaaatctgacttgtaaaaatctctctatagcccttattttgtggcattttatcaaaatgctatgaaatcagagtccattttctggctttctagaagttaccaaatataaacatttccccaaaagaaaccatctaactagtggaagaccttacgccaacaggttctttctgctctatgaatgaatccgccttttttgccggacaaatacaatccattgtaaatgtcaggtttctctagaggggggtgagaggccacccgtcagcggacacctcaggcacctagagaggaaggccattccacaccagacgccacaagaaacccagagatgcttccaacagcgagaagtaacgagagtaaaatcagacacgattaaaagatgctgagctgacatacacacacataaagcttcccagctaccgataccagctttaaaattacaataacaaggttaagtggatcaaccttggccttcctatgtgtaggtagaattcctgtctcttcccagtggaaatcgtattgatcccgctgctgctgaagcacctccccactcagctctgatttgtaatttatgcacttgatgcatattttagaaaatcaggctctttccaatgctgcctctcgacacacaataatgtgtgttgtaatccaaatgctgactttaaatccatgacatcgagaccatctccttttccttaacctaacccatatcaaactggaacacagaagggaagcttcaaacatcctcaactttctagaaagctcctaaatggaaccccaaagtagaaacgtttaaaaaaatttgtgatgaagccacttttgtcaactacagacatagtttaaataaaaaacaaggcacacttacaagtcacatggaagccaggaaccttcacattccaacctgaaaatacactccgaacccctcgcctacccttctcctttggtgtgtgaacacacaggctagcgggacaggctttgcttcaaagacatgccacgcactgggttaatactgtcggaaacaccagtaagcaaaggctgagagactctattatgctacatgtaggatgacaccaccgacgtggctcaatggaagcaaaaccgcttcctgctagttgagtttttagtgctttcttcttttggaacaccattgtatttcataatagttactaaaaatttggtaaaatatattaaggattctttaacaaatgccacaagttcttcaaataattgaaaaaagaaagaaaaaggaagaagaaaagaaagacttcagctcaaagctgtgttcaatggaaaagaaaaacatgatagaacacaggtaagatgaagtcaatggcttcggggggttttcatgacacagaaaaggatgtatttttgaaacccacttttgtgtgcagaatcagacagtgttttcccatcctaattctatattccaaatgggagttaaagcttggttataggtgctaaggaaaagttggctgccaatttgactctatttttgggttgctttttggccgggctttccacggggtccttgctgagcagtgactcggaggtttccgaggaggggcagggaggcacggggacagctgctgagatgcaggacgagctggagtcagaggtcagagttttgctctttcctggtattggaatctccattttttcttcttggtttaaaatcataatttctgtaaacacagaaaagcaaacagattcagatccaggaactgtaagaagtgtgggttttctcttccttgctcatattttctcaaaagataataatagtaataaaaagcttctaaatgctacatctatgccacagtttacatatgagttgtgtggccagtgaacttggcacagaaatcaagtatctataaactgcatcccacctctcccactggattacaaagttggaaagatctctattttgagctataaatgaatgagcaaaggttaaaactttttgtttttccattttggattctctgcccattcattctgcctgccagatattaaggacccataaagctatccacgacttagagacttcctgaggcgggaggccgtgggtggtagggggtggggtcggagcatctgggtgtcagggagctcctggcctgctccatttagagaggacctatgctccccatgggtctattaccggggataaggaaggactacgcagagtgagaattaccctcagaacccaggaagttgagcacagccagctttcccacagtgcttctggactgccatttctgtggctgagccacatgtaattcacctgctctacacacagggccacgctgcttgaaagagatgcatcattatgccttagactcccactgcatagggcacagggctcctgctcccaaaggcccatggaaggtgagagtggcagaggggacagcagagccagctccctgcctaggctgaccctcaagagaagagcggctgacagaactgcccacagtgttttaattattttcctctcttgtccggtgcatgcagttgaacttgcccagactgaaggcacaaaggccacaaccccacaaacgagctaacatcaatgtgccaccaaccctaggggggcactgcacaggagcagggcatggtctaggtctgactgcacaggctggttctatccgcaggcagttacttccccatctcctattttccaagtcaacagcctcagttcttttcctgggcaacagtgctgaacgctgccaagaacaaccaagatggtaaaagccaagccaggagtccacgggttgttcctggtgacctggaaagcagcaccagcagtggggaggagttgggttccaacagatgaagagcagggagggatctgtacagggcagatgggccatcctctccagaggccaggagacaccgcaggacaagagggcttgggttccaatgccggctctgcccttgctagcccagcagcccggggccactgcctctctagtgacggcaccagctgtgccttagtcacgcagcctgtggaataaagcagctgcctttattccacggctctcacctggagccgtggtaagagttaaatgtgatggtgtctgtcagccctgagcacagggtcagtgccaatgcctgcactaggctgggactcagtgtgctcagcttcctgtctgttatatcactgggcagagtccggggctccagccacagacacctccctccattcacccctttataaagcccttgggccctctggacccccaccatgggtgacgtgtacatctggtgacaggtgtgcctgagagcagctgaaccttcacaaagtctgggagagcagaagcccaggaggccccacccacccctgtggactcgcccacagccccgagccaccagccctccagagctgccaaatcgcccttgcctgatgctcgccaggcaacctcaggctgtgcatcccattctgcaggaacccaggtggggaaagaaggtcgaataatcagcacagtgttttccacctgaaaaggggtagtcccttcccacctccgtcatttactatatcagtatctcatcgtggttttgttttaaaccccgaagaaaatccccatgacaacatggagtcacccaccagaaggctcttgagggcgctcctcaaactgaatgagatcagcagattggaggataacggggtctggtctcagctgaggggacggcaggcacgaggggacaggcgcacacaggaggtcgacgggggagtcgtcggtcaggcggagaagctcctgctctgtgtgactgggccctgggcaaacaaggagggccgtgacaccacaggacctccacgcccacccccagcacacaccctgggctcacacctgaagttttccttctaagccttaaagataagagagtcaagaagtatttaaggtattaaaaaaaaaaaaaaaaaaaaacaaaaacccaaaacccactaacaggaagatcctggtaatggaacgccttaataagctagttcttctgaagatccgtgttcttaggaacactggcccctcaaaagacccaaccagagaaaagggtcctgcagtcagcttccaaagagaagggacagcctgagacggggtgtacgtagttaacagcaagtggaagctcagaatccgaagccctgggcctggttccgtggcttcctagctgctgactctgggtgagctgtaatacgtgactgcctgagatttccgagcctccgctgcacaacggaggtcagcactgctgaaggctgtggggcagcttcggcagatgattcccaggagggcgcttcataaaacgtcaaatgctgtgtaactcagttatcctaagggcacaggggacggtaacgtgctatctcgccgcatgttatgaagacaaaattctcacctataacgatgaattcaaaagtccttcagaaaagttagaactgctataacattccaagaattggcctctatctactacagaggtggatctatctgaaatctatgtgactcagtgtaattttgggtaatattaatgcattagtatatcaaatcctgcctagggctgtcctgtgacaaagacgccttgaccagccatgagtcaggcaccctgagccctcttccggatcaggcctgaccttggccttccatgtctgttgctgaacttgccggctcgctctagagtcttagcttgagtcagtttagtgagaatcccctcacccttcacagctgatcgaattccttattcccaaccactgatgtctagatccttggctggcctgcatgcctatagcaagaatcctcttagtaattttccacccactgagccctcactctgctcctaggctatgtattgggagttggctctctctcccctgttgcaagtgtcatgaatatccattataataagtgtcggaataatttttttcttcaacatctgaactggggtaagatgatcattatgggggtgccaacatccttcagggactttaaccagtcaaccatgcaatgctaacagataaaggtcaattttatcctgttactaactaaataccaaaactgctttgaaaaatgtgtggctatgtaacttcagcagattggatgacttgctggagtcctttccctcgctctccccgaccccaaagccgtttctcctagaatttcacaagctcctatgtctctgcttttcctctcttaccactgccgtcagctccaagcttgagttccgaggctgtgtgcgattcgggcacctccaggatgcgctcgccctccgagggctggttttcatgattggcaggggagagactgagtgaactcaaacgacctacaggacaaagagcacccgtcagagagaaatgtcagtgagagaaccgtgattttttaaggggggaggggatgggtgcttacttacttttcatgtcattttttaacactacaattctcttatgaccatgtccttttatccagaccacctgcacacaagacatactactggttaagcagcggaaaaggaggggacagaagccctaacattcaggaagagtgtgacctacggagcctgccttaggctagaatttaggagctgagttactgccaagaagcatgtttctctactctctccttagcttttaaagcaacagaagctgacagaaacatacccctataaaaagcagagtagttcaaaaatcatgagacacagtttcagaaatatcctttataattcttaaaaagactgtcttccaaacaccagctttggcatataaattaaggtagttctcacatgagagctctttgccatttttttgcagaaactgaacaaccacctaaaagaattaagagcaatctctcagaccctttaaactaagttcattatcagcatcttaaagtcctctccctgatggtgccgctctccatctcagccaagcagagtggtagtagtggagctaggctcccaggccccctacatgtgcacaccgtcgccaggtcactgatctcagctcccaggcaagctttgcctgggtccttcctacttcctctattctactatttttactctggctcaatccctccatctaacactgacccagacctctgcagtggccaggatcctagcccagttcccttctccatgcctgcttctctcggctctaccatggacagcaccactggggtgcttttcaaatgcaaacctgggctccagctctctccaacacagtcctccctccttacctggaggagccacgccctccctaaccgagctctcagctccctcttagcctctcgacactccatgccacttgtcacaaccctgcatctgctcatgtcatcatcccctttgcccagaatgctctctcccctccttgtcacgtgcttccctcaggcacatccttgaaggttttgcaacaggctccccaggcttgggaagtgggccctgacacggccctcctcagcgcgcccactgccctgaccgccctgactagttgcctgcttgggggtcttgactctcccattaaccaacacctttctagagttacagcctgaaacttactcacctggcatatagggatttaataaaggtttacagaaagaatcaaggagaaatgctaaaatcatttactttagaccaacagtatgttttgaaaggatcaattcaaaatgcctgccgttccattattctggcagcattttatttttctgttcaggacagttagcctgtggctgttcagaagatgctctcccggaagctgagaaaaatgcccacctgtggaattgctcccaagagctcctccacgctgctgtggccgtaggtcttgggctgcagagtttctccgacatacttggtataggccatggaaaactcatgaaggaaaatctgctggtagtggtaagtatgaagtaaagaccgcacattctttgcaaacaaatacagacttgtgagcttcacacattcttccatcttatcattagtgaaaacctggttaaaaagaaaacgcagcattagaaatattagtgactggccctgccccgtggaaagtgaaggcctcccactgagggaaaaggcccagagttgaagacgaagacaaagaagaaaaagaaggcaacgaagatgagaagatgaagatgaagaaggagacaaagatgacgaagaagaaggagacgacaaagataaagaagacaacaacaaagaagatgaagacaaagacgacgagacaaaaacgaagataaagacgacaaagatgaagacaaagaacaagaagacgaagacaagacgaagacgacgatgaagaagacgaagacgacgataaagaagacgaagacgacgaattggacaaagacaaagatgaagaagatgaagatgacaaaaaagacaaagaagaagaaaggaggaggaggaaggaaagaaggaagaggagaaagaaaaggaggagggatatattcaaggatttcctccaagagaaggctatagcctccagcaaacttcagttctatttgcaagtcgaaggctgcagcggtctgaagagacagtgtgtgagtagggaagaaatcgggggaggcaaactgtgttggcaaatcacggtacacacagtgaacactggggccattaaactgcacctccaaaccagttttccaagaaacactgtgataagaggatgacactagcattctttaaaaacacatcaaaagcaacaagaaacaaacacaaaacccttgtgtatgcagggtaaggaagcagatttctttaccacaaaccttttcaaagtgtttaacatgctatggaatcgccaagagaaaggatattcccaatcttagctggacagggaaagtcctttgtcctgaaatatgcattaacacctgtccagaactggtgttcttaggatagatattaacagagtttagaaaatgctggatgtatatcctttcattatttaatgatgtgtcccacagttagatgataatggcatatcattcttttaaattgctggagctcatttgttaatatcttatttaggatcattttaagggactatcttatgtttttggtattaaatttattttggcttcgtaaaaataaatggtaagctttccttttttctttttcagcagcctagaacagtattttttttcttggggatgggttcttgctatgttgcccaggctggcctcaaactcctgggctcaagtgattctctagcctcagccttcttagtagctgggattatagacgtgtaccaccttgccgggccccagaatggttttttaaaaggtagatttatctgttcttttagggttggttgaaattcaattgttatctcacttggtcctgatgcctttttcactggtatatttcagtgatcttttatagtctcttttatggtaattggtctaatttttaacttcttgagtgaattttggtaacttattttttccaggatttcatttatttactctaggtttttatatctgtcgcccgagaattgcatgcagtattctcttaagattctctcaatcttggagcgccattcttgaaaggctgcctgggggactggctggccaaccttcctttctgccctcaccttactcatctctctcttcaagccaccacataaaccatctcattcagaaagataaaacagtagcgaaatccatcctggaatgggacaaacacaccccagagccaggatcaggagaccaggctttcatcctagaacgggacaaacacaccccagtgccaggatgaggagaccaggctttcactggcttctgccacccatttaggcagggctgcttcactgcctgaggtctcggcgtgttcatccatgaaatggtctctcgggtcccttccagctctacacactctaatctagaccatcaggtaatccggaaatgcccaatcgatagttttcaatgatagttctaaagagccattaacgtgcctacctcaaccaagtatggcaggctcttcagcagttcggtcaaggtcatgaatccatattcacaggggttaaggggagtgttgtgggtactttcgtaatgtctcttgagctcctcaacagaaagatgggtggttccttcccaagacatcaacaataccagcaactgggcagtgagagatcgcagagactttcggttgatcagctgaatctgtctgccagattctatatcggcaacctggggaaaacgagaattcacacttttcagagctcaagagagacaccctaggttatacccaactcagctcacttcattttggttaatgagaccaacagatgaaaaatctctaatttttttctcttacactgaaataaagcaagtgggtttgtttttagcgtctttgggacaccagaccaacatggaagcagaaactgtcctccccctgccggtccataactgaaaactctcaacaagataataatgggggaggaaattgcatcattctctttatttttcattcattctttccaaaccccactataagaaggacacagactggccagctgatggccagtggtccaagcttgtgaagtgtgggttgctgtgctcgaaggggggtagggatggggaggctagactctaagcaacactcacatggcttctgtgcagacccgacttgcccatatgcgtccccagggcgggctggggaggtgagagagggcctactctgattacaaggcaagctgcatttttctagtctgctattactcaccacaaagctggtattttcatctgactagtaactgtccactcctcaattatttcagattctcaaggagataaagggtttaagcggttaaatgcgctgagagggaaaccttacaaaaaagacagagattgtcacttggggaccaaacaccatgtgaagaaacacgcatctggtgactgagccagcaggctgtgggtggcgagggtgaggctgtggcgtgagcctttcctggcacaaaaacaggcagagctttggcacacacacggctccggcactgctctcacaaaccaatgctcatcctgacagcttgtttgccccctttatctggttttcctgccagggccaaaggtcttggcagggctaagtcaccacaagttggcactctttggaccgtggattctgagaggcagagagaggtgggtggcacttgaggagccatcccaagaccagggcatctttatctggttctgacatgtgcccagagccaaggcaggagggaggctggcagggtcccaccctacttatcatgattatgggactgtatagatttcctcctcagaagcgggtttaatcaaccaaccgatacaagtccaggggatcccagtcatcttagccacccagacccccaccatcactacagctgcttaggaaagaaaccaaaccagagcctgctcctctggtgcgacttggatccatcccttgattctcaatcccggctatgcattagaattgcctggggagcttttaaaaacaccaatgctcagagtgtgctgggactaattctataagaatctgaaaggtaaggttggagaagctcccaggagacccagtgggcagccagggaggcaccacggagcctctctcagctctccccattcttgctgctcacaccccagctgcccacccatcacactcacccagcaaagccctaggtcatggcgtggggtcttcctatccacctgagtccacccctttcatcatcctgggcaactgaacacccagggacctgtcccacaccacagccgtatagcctttcaatgccttgcctctgtcatctccgacgacatcctcctgtgttcaatttcactgcagacacccatctccagggtcacagtgcaaacctgtcattaccccatccaacataaatcattcaaacctcctgagcatcccacttgcaaaagcaagtctggagctgctgttggggtgggagtgcagaaagagactctacccgctcaactccgccccttctcaaacctcagcagcatcactgcctcctatctgctcccaatttgccagcccactcccttgcttcactctcctcttttgtcatgctggcactgacattcttgtcaatatttaaattcgctcatcccatgccttttcctgacgcccatcggtaaactcccaccttgaatccaaccacctgctttccctgaaccgacacctgcatagccacaccccaactgctgctctcccagagtctacggtgccaacttgcagtgagctctcgatacccctgcactccacgtgacatcctgatcaagccactctccactcaccatgacaactgtggaccttctccccactcctaagtcctgagccctgcctctcctctctctctctaagcagagatcagtccctctctctagtggaaaaccactcttggaagaggactcccttctattcctgatgataaacatcagacctgcccatgcctgcccccagcctattgccctgtatacttcctccttcctctgtgtgctgtttcctagtctcccacacctcaaggccctcctgtcttaccccttctcgcccttgtatgttcatcttctctctctagacagatccacatcaatggctttcagacatgctcaagtttttccaggtaggaaaaccaacagcccaaatcctcccttgctccctcagccccacagcctctagctgctgccacagccctccatcttcacaagcagacaaaccaggatgctgtccagatgacctgggccattttctcacctctcctcactcctcaccacactccaaggtggcttctgtctacacaaccaacactgccactgacctggccagcagcaccgactcttcccactgagctaaacctggaagtcaggcagtccctctctgaccagccctcctgcgatgctgctggccattcctctgccttggctcagggatgttcggctctcctggttgtgcttcctgctctctcacctcctcctccaaccaatcagtacctaaggagagctctgagcgttcctacctctgccaaggtaagaacgtcttcttagctgcagtccaatacattaaaaaacagtgggggctgggtgcagtggctcatgcctgtaatcccagcactctgggaggctgaggtgggcggattacctgaggccaggagttcgagatcagcctggccaacacggtgaagccctgtctctactaaaaatacaaaaactagctgggcgtagtggcgggcgcctgtaatcccagctacccaggaggctgaggaagaagaatctcttgaacctgggaggcggaggttgcagtgagccaagatcgcaccactgcactctagcctgggccacagagcaagactccaactccaaaaaaaccccacagtgggaaggaaagggagagtgaacccgttctggctgtttacggaattaaatgacacagaaatgtgtgcagctagtaatgggcctgtaactgagggtgccgtccttcatgcttccctttccattccttcctcctggcagtgacttcttctggtcctgtgggggaggaggccgaaaactggcagctgctctgcctaggacaggaagggtcaagtgcagtccaggacagcaaacagcacgagctgccctctctactacagctctgccagtgacaaaggccactctgcaccctcgcttgctcctaagcctactcctaagtgggtgagaatgtggagggagaggacactgtgtgattacgggctcccaagaacgtcacaggcaaaactcacactggaaggagtcaagctcaggccagcagtgctgaggcagctgcacctcatgaccgaaccctggggtgaagagtgacctcatcagttcacaaaggcattgctttggcaaggccattcagaaacacacaagaggaagaccaaaactctcaacttccaaaccaaggcttctattacctaataagcactaatgacacaaaacgagtcataatgctgtgacagttaagtagttcaaggtgtaaataaagaaacgctacagcacacgcaaacgtcctaatgagaattaggtcactgtgagttttatcccatgagggaaaaaaaaaaaaaaaaaaaaaaacatttaccttcacgacatggcagagtttctgagttaaagccgaaatggaactgacatcatagtcttggagacgaaatgtataaccaaaagttttagcatattctgtaaggagatctgtcatcataaggcagttatctttttgggaccgaaggagtttaacaaactgggcagctagagctttgaaccgctccacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggtaagttctatgttatgtgtattgtgccacaataaaacaatttttaaaaagcacttcagtagtaaaaaaagaaaataaaatcaacaacagaaatttggtttaacttagcaacagcgaacagcttagcactgatgttacctcatgtactcagacctaccttcaacacgaaggattttaaaagtataaaagtaatgaacaaatattcagtgtaagaaatcagcaggtgtggtggctcacgcctgtaatcccagcactctgggaggctgagacaggcggatcaactgaggtcaggagctcaagaccagcctggccaacgtggtgaaacaccatctctactaaaaatagaaaaattagctgggcatggtggcgggcacctgtaatccccagctactcgggaggttgaggcaagtgaactgcttgaacccgcaggcggaggttgcagtgagccaagattgcgccattgcactccagcctgggcgacaagaaagaaactccgtctcaaaaaacaaaaacaaacaaacaaaaaaaagaaaacctactgaatctttttttcaataattacccccaaaacaagtttgaataatcctttattgaaggaaaaagccatatttatctaaaaatactaatgagtcaggaatatggcttctctgactggaatagcttagattttcatcctctttcgtaactccctacttcccagaaaaacaggtctggaacgtgaaaaagtatttcctatacgttgttcagaaaaatactttataaaattagaatttcttcactcacttgtaaagtatcaggtatggcttcaaaaagttcaagtagtttggtaaacccatagtacgcaagtttgcactgccggccaaagtggtgatggtaagaagggataaatttattaaagggcatccggaaatggggttggtgacgcagcaaatcaacgacatccttggagaactgttttgtcctttctatttcatcctgagtgcgttcttttaaaaaaaccaaaaaacataaaatcacagtttttttctacccatttgtgttcaacatccacactagagtaaatccttttgggaatttataaacgatatcatccttgccttccaaacacacacaacctaaaacaaacacatatactcttccctctttgcaagtggttctcaaacatgttccagggcagaacaccaggaagttatgatattattatattatgaaattcatatatattcatcttataagctagaaacaatgtcatcttataagctagaaacaattttctagcccctgccccatatctattaacatgacacacacccaggtccctgtacttaagcaagtactctagaaattattcccatgaaatcacgcttctgaatatccccactttttttgtttattcatctgatcttcagttaaaacttgctagcagaagagagaatcaggcttcaaaagttgaacaaaaataaacaggagggaaagcttaagctgagattgtttctattaatttttaagtgagaatgggccctggaattctatgatttcatggacatcaatgttctgcaggagcaccgtttaagaaccagataatagaaggaggatacgaccatacagtcaccccttggtgttctcaagggatcgggtccaggaccctgcctggataccaaaatccgcacctactcaagtcttgcggtctgccccgcggaaactgcagacacgaaaaattggcccccagtatccatgagtttcgcatccctcaaatactgtactttctacccgtaactggacctgtgcagttctgacttcaactattaaaatttgaaaggcaaaagaaaaaaaaacattcgagttgtcttcccttctcaagtgtgcacagtaaataaagtagctcagagttcaacagaagagcaaagccaacaggcacggtgacagattctcaactggatgactaaggctcatgtagccacagccaggctgcagaaggcatttgagcaaagtgctgatgatgcccctttttccccttagagtcaattctaaaaagccagcctgcttttgttcttgagaacagcttcacctactttgaagaacacagaatccaaagagcagcagttttcacactgtgctttctgtggaatcttcaggaagcacggacagggagggaaaaccacatcttccatgccacactatgttaaaataacaggagatagacaatatccttccagcaaatgttaagtcacatacctcttttggggatacaaatcaccatttcattatcttgttgggacaagcagatggttgtgtctggaatctctgatacgatgtcaatcaactcacaaacaccatattcagtgacatcccagtcctttgagaaacacctaggttttaacaacggaagtggatacggaatgagtagtatcatcggtagaagaactacaagttttccggccgggcgctggggctcacgcctgtaatcccagcactttgggaggccgaggtggacggatcacgaggtcaagagatcgcgaccatcctggctaacatggtgaaaccccgtctctactaaaaaatagaaaaaataagccgggtgtggtggcgggcgcctgtagtcccagctactctggaggctgaggcaggacaacggcataaacccgggaggcggagcttgcagtgagccaagatcgtgccactgggcgacagagcgagactccgtctcaaaaaaaaaaaaaaaaaaacaaaaaactactacaagttttccaaaagaatgcttaatagaaatactagataactatttagagtttggcagaagataaaatgtcctaaaatatttactttcatttctgttcttttcatcaactcaccagtgataagcctgtgagaattctctcacaatgacctgtttgctggcctgggatttgagaagttttagtaaatcctgagtaaagcgcttcacctgggccctgtgggtaagggtcagcagacgtttggagcccattccaagaatctgcaaagcaaatagtttatttatacacataagacctcagcagacagcgacttccttgctgctggctcaccctctcgttactagcctcagagcatgactccctttatgtagaatgtgtgcaatttgaaacacatgtcgatcaacaaaatgtagttggtcaaaaggaacaaatgtccaaggccttctgaaactcttatcgtttttggcctggcacaccttctcccaaacagtcgttgagtataaaaatgaaaagtgtaatcttttgaaaagaaaagtcgtgagtacagaaatgaaaactgtattggttgtccagacaaattggtctacaagtttttcaagccgtttttagtgagtgggaagctgttataacactgtgagttaactggtaaaagtcttcataggatccagtgctacactctagcccagtaacttgtctccaactagttaaatttagaagaaaggttaagcccttgactctcacataggcaccaacatacaagtatgtggctattcatgggagcttccttgtaatcatgaacagttctggagaaagctgtgctgggatgaagaaggtctatagagcttagagggaaaatactcctcagtcctccaaggagttcctctaaaactggaaactagcagcgttctgaaaaattgagaagccgcctgtgtgtgttattcctgccctctgaagaaagtttttagtggatgttctgcccagaactgacttcttaggaattaaactgtttctttgatggaggcagccaaagccatggaggaacattcctgcctgtaaacaagtaatcccgtgacacgccttacctgcaatacatgaggcactgcttctaataactcaatcagcttggagtatccgtagtctgacactcggcactgctttgcaaaatgatggtgataggatgggatgaaatgactgatgggtatgacacaagatggctggcttttcagcaagtcaatcacttctctactgaactggatcagctgggggttacctacaggactcttcgaacgcagaagccaagggtctagaagaaaaagaacgtgtataagacagaaagcacagatttcaccagctgaaagaagggaaaatggccctgcagtccctggcttgagttcgatcatggggaagcaaacaaaaccaaatacagtagctgctttacgtctcagtttctatattcaggtctcatagtccaataactagctaactaacttattcacgggctgtcaaatgctgtcccactaatcctcaaagttaagcggccaaggtaaagcagagtctactatagtgttatttatagcagaagtcaaagtacacaagaagctcccagtttagaaactagttatatttccaagatccttctgaaacttggtcatgtggaacgtacctttccacaaagttataaatggtcatcaggtaggtggcccagaagagcaaaattaatccatagtggagctgaaaacgttacccagaaaaccacagaaagtgataatgttgtaagattagcatgacataaaagggtgtaaggaacaggtttttgcaccatcttgactgcttatacctattaaaaaggtataagtaatcaaacggaaatctttatagaaaggtggagaggcttgctggtcgcggcggctcatgcctgtaatcccagcactttgggaggctgaggcgggcggatcacgaggtcaggagatcgagaccatcctggctaacaaggtgaaaccccgtctctactaaaaatacaaaaataaatacaaaaaaattagccgggcgtggtggcaggcacctgtagtcccagctactcaggaggctgaggaaggagaatggcatgaacccaggaggtggagcttgcagtgagcctagattgcaccactgcactccagcctgggacacagagcgagattccgtctcaataaataaataaataaataaataaataaaataaaataaaataaaataaaaagtggaggcttgtgggctcatggcttaggagaaaggaggagtggcataatctatggcccctgagaagtctaagacagagggaaaagaaaggaggtgtcccgtaagaaacctgagtacacacattcctaagagcaggctgactcagaaagaattccttggttatcctcaccttttttcctgtagggtaagggaggtgggagaagcaaaagtgttggggacaaagaggaggaagtatgtgtgtatacacaggaaggcaacaagtaaagtgtcgttcacgggcagcagccttggatatctgcaactcaggacatgcccgtaactcagacactcacccaagtctaggtccaaataccttggtcttttaaatttattttcacatttatcaaagtccaaaacgtggaccaaaatgactttcgaaggtaaatctgcattaagtggtatttccttcaaatacctgaaagtacttttttttttaaagacagagtttcggccaggtgcggtggctcacgtctgtaatcccagcattttgggaggctgaggcgggcggatcacgaggtcaggagatcgagaccatccttgctaacacggtgaaaccctgtctctactaaaaatacaaaaaaaatagccgggcgtggtggcaggcgtctgtagtcccagctactcgggaggctgaggcaggagaatggtatgaaccgaggaggcggagcttgcagtgagctgagatccggccactgcactccagcctggtgacagagggtgactccgtctcaaaaaaaaaaaaaaaaaaaaaatcctgggcgcggtggctcacacctgtaatcccagcactttgggaggctgaggcgggcggatcatgaggtcaggagatcaagaccatcctggctaacaaggtgaaacccgtctctactaaaaatacagaaaaaaaaaaaaattagccgggcgtggtggcgggcgcctgtagtcccagctcctcaggagactgaggcaggggaatggcgtgaactcaggaggcggagcttgcagtgagccaagattgtgccactacactccagcctgggcaacagagcaagactccgtctcaaaaaaaaaaagacagagcttcactcttgtcacccaggctggagtgcaatggcttgatcttagctcaccacaacctctacctcctgggttcaagtgattctcttgcctcagcctcccgagtagctgggattacaggtgcccaccatcatgcctgatttttctatttttagtagagatggggtttcaccatgttggccaggctggtcttgaactcctgacctcaggtgatttacccacctcagcttcccagagtgctgggattacaggtgtgagccaacaggcccagcccctgaaactatttttaaaaggtcagtcaactggcaagccaaaagcttcacaaaattaggttgctaaaaggatctgtaaatgtgaaatttgagtttcaaattttttacatagcttatgttggtactttcaaactggccaggtgtggtggctcatgcctgtaatcccagcattttgggaggccatagtgggacgacatcttcagctcaggagttcaagagcagcctggacaacacagcaaggccctatctaaaaaacaaagtctaggccggttgctgtggctcaggcctgtaatcccagcactttgggaggcggaggcaagtggataatgaggtcaagagatcaagaccatcctggccaatatggtgaaaccctgtctctactaaaaatacaaaaaattagctgggcgtggtggctggtgcctgtagtcccagctactcgggaggctgaggcaggagaatcacttgaacccgggaggcagaggttgcagtgagccgagatcgcaccactgcactccagctaggcgacagagcaagactccgtctcaaaaaaaataaataaataaaaaataaaacaaagtccagtaacgccaacccctcaagcattttaggaattttcaaaagatcaaaggacacatccatggtgttttcacacttggcaaattgtgctgctgtttaaaataaaagccaatagcctcctctggtctcatagtggacaggtggtagctccaggacaaaatacctgacacctaccagtgttgggaggcgggggcttgttgtgaatccatttaaccactttgatgccattctgagcagtggcaatgtttacacctggaacacaggtaatgaagtgttctaagggaacacctccttggttttcttgcactacttctagatcgccaaactctgcaatgtaacaatctggaaagctgaaataggaaaaaacaacaaaaaaaggaaaggttaaatcaaaataacagaaaaggaggcgcttgctaaacagaaggctttggtttaatgtatgtgttaatcatttgtctgaatgcccaccaccaggtttgaaggttaaaattaaggacccagggaggcaagcactgaggcactggcctctctgatgcattctgatggcattttctgggtagttttccaggagggggattaaaaatagggcaactgggctccaagtcagttacgcgtctgcttccacatcagcagggacgtgcaggccactgagtcctgtgttggcctttgtgttaagtctactgttgtggctcatggagtgattaaatgaacttctgaagaatacttttctctcacaagtcttgaaatgtatgcatatttgaagctgtgtactctcaacacttgtggagatttcgactgcagcacttatgatacatctcccctctgtggaagaatctgccctcctcacgtttacgtttctaaaatgtagcgcaaacacacattttcttgttgaagtactgagtgaatggatcccatttcagataaacagtcacgtgctgcttcatgatggggatatgtactcaataatgtgttgctgggtgattctgtcacctgagaacatcatcaggtgcacttatgcaaacctagatgctgcggcccactgcacacctaggctggtgcagcccatggttcccgagctacacatctggacagcctgttactgtactacacactgtgagcaactataacacaatggtatttgtgtatctaatcatcgaaaggtctagtgaaaatatgtgattataatcttatgggaccactgtcctatatacagtccatggttggccaaaattttgttatgtggtgcatgactgtactttgactgaaggctaaacacatgaggatgaagcattgtagagtacttatttgtaaagagatgtgggcagaaagggcaggcttcctataaaaagcagaactagggcattatatcgacaaaggctttgagatggttcacctcaataaaggcacggtgccctcgtgggtctggagaagactgtgaacctggggcgcaaatgtcttcaaagaaagaatcacaaaaggaatcttgtaagagtctggatcaaattcatgttcgctgaagaaaagagaacacaattggaagctgacattccgcaggggtctaagatgttcacaaggtcatcctaacatgttccacaatcttatagaaaagaattacttctaaaggaaaacgaacggcacacctgaaatccttattggaacaatgctgtctgcagacaggctcgtgatattctaactcttcaaatataattgggctgcaattcgtggaggagccgtcgtgtgactgggaagaccccaaggggctctggcgggcctgactgctgggtaggagacacaccagccgtccgtttccttgttcacggattgcgaccgtgtctgttaatttatatagatctgacacattcaacttgtgtccaaacctaaaagcaagagaagagagacgctgacttagaaggtttttctttgattatacagaaacacgcatcctgtttaaataaagaacaataaccaagaatggttcctccatctcttcaaaggtaaaactggaataattctactacaaattcattcactagcaaaccagtgatgcttggtactcctgagtcgtctctggctccgaccatgacaatgctcacttcatttgaaagccacccccagcccctgcccagtttctttaagtgacctcaccaaattctcttgagttggaaacctctctcgatgcagctcccctcacttccaattctctgtgttacttctcaccatccccattctcccctctcagaagtatatgtgctttccgtgaccctctcaactctcctatgcctcaactgcatgatccacacaccctctgacactggactccccagttctcctcctgacctgtatctttcttacttggaacttaaaggcactggccctggaggctggcagatttgagttcacatcctgactccacttcaacctgtgtgaccttagtcaagttccacgaccaatcggggcctcactttttccatctgtaaaatggggtgatgatagcgcctatctcacagggtcaatgtgaggattaagtgtggttaggcctggacagaacttggctcatagtaagtgctcagtaagtgttccctggtcttctcactgtctgaccagtgttttcttcccagtgtcctacatatgctcagattcccatctaccaaaccagcccctggtcctcttccacctcccggagagacacactctcccttgtactctcattctcagtctcgtactctaccctgtccctgtaatggaaacatccagctgctcaggagctgcttctgctgtgttacccccgagtctctcagccccttccctactggattttagccacaggactctgtagtgatgactcaaaagttatcagcggcctctgcctcatccccacacctcatgcatttcctcatggccttggatccccccattcctgatgtgctctcttggcacacatcctgggtgctcgcccacatccctggccctggtggcattccatccattcctgccctctatttctccttccccctcccaaccttatctgctctctagtctgtcccaatcgtcttaaaggcaaatgactgccctatctccagagcctacttctctcccaaagaagtccctcaatgtgcagaagactatgtgacctctccacccagctactccaatggcccctaaaacctgaatgtccaaaaccaagaccaaaaacttgctgtacctccttgccatgctttatttccctatttccagtttaactgtgcaaccatcatcccagtcatgcaaggcaaaacactcagaatcaaaatgacctctcccttttaccttgcttgctacataaaactagttactctggctggacgtggtggcccgtgcctgtaattccagcactttgggaggcctaggagggagaatcacttgaagccaggagttcaagaccaccctgggcaacatagcaaaaccccctcattacaaaaattaaaaaatattaactgggcaggatggcggatgcctgtggtcccagctactcaaaaggctgagatgggaggatcatctgagtccaggagtctgaggctgcaatgacctagggtcgtgcccctgcactacaccctgggtgacagagtgagaccctggctcaataaaaattgtttttaataaaaaaaattagttacccactctagtttcaatgacatttgacattttgacatttctgtaacatcgagttctgtcccaacagtatctgctctgaatttggactgatgtagctactttccctctctgcctccttctctcccctgttcctgccctctcagacaccactgctacgagaagagtcttcctgcagcatgattcccatcaccacacctttcccctcccctccttcctccagcacttcagtggctccctattacctgtgggataatggccaagttccttgttcttcccttcctctgtgttctcaaagctttttctcctcctttccaatcagttttcttcactgtccataaggattcacgagcattttctcttcccgctagacataagctcctcaaggacaagacctaagtcttgcccagttctgccttctctgcagtgccttggtcttgtactcactagtccctgctaagcatctactatgggctgggtgcttaggatacagtattatggcagagctagtccctgctgtcctggagcttatagtctagtgcttaaaaatgttcatccaataaatactaaaacttggccaggcgcagtggctcacacctgtaatcctagcactttgggaggctaaagtgggcagatcacttgaggtcaggagtttaagaccagcctggctaatatggcgaaaccctgtctctactaaaaatacgaaaacttagcaaggcttggtggcacatgcctgtagtcccagctactcgggaggctgaggcatgagaatcacctgaacttgtgaggcagaggttgcagtgagttgagattgtgccactgcactctagcctcggcaacagagcgagactctgtctccaaaaaaattaaaaaacaaacaaacaaacaaaaaaaacaaactaaagctagtcaattaggggaaaaataagcacaacactgaggaccaaaggtctaactttgttaaaaataaaagacgttttaaaactgtctgctaaacattcattgacatgtaaatctgaatgccagtgtctctgtctcctctcctctaccaggctgaagttcctcaagagtcattaccatggttttgtgcatgtaagccaccaatcagtactgactggataaagaaaaaatatacctaacttactttttttcatagatatctgtaaatttaaacagaggcaggcaacaggcaggggcatcctgaagaacagacattgtttctgcactgtaaaacagaagtttgattagggaacagaccatttcctccatattacaagttatataaacagagttcataaaattaacccagtgcatatgcaaaataaatttacggatttctggtatgtcagaatgtattttccagaaaaatttaaagaaaggattttagggacaaggcaatgaaagaagattacgttacacagtagaattagtatcaatcatagggttttccacaccagtggagcagaaaagcatgatgaattcagagcaaaagggagaagagcttaaatatctcctgccacactgcagtttgttagatatatgtgattggcgttcccatagataaggatacacaactgaatacaacataatctcaactacagttttaaaaaaccagaggcaccaaaaaacgctcaaagggaaaaaatccaaacaaaactaaaagaagatgccaaactgttaagtgcaattggctttgggccataggcctgtggatggttttttttcccctgcttcttttatgtttctaaactttccaaattttcttcaataagcatcatttttattctgagaacaacaacaaaaaaaaaacccgtaactcgtaatttaagtaatagtgaagtacaagttagaaaaaagatctctgatcatccaaggaaacactcaggagtgggtcctgttttgccagtctccccgaaacagggagacccaaagaagtatcacattttactatgaataaaaccatcaccagacgcttgagactgagatagtcttaaggtagacttatggggctgagtatctatttgacactaaggatatatctgcaaatggagagcttgaagatttgtagatctagtctttacacacaaatctaccttctacctaagatctcaaggtaatattttagacttttcaggcttataaacttttattgtaggggtctactatttttagaacctatttgaacatgttgcgtattattttactcccaagtgcctgtcaagtttaagctgtattccagctttgattaatgacttagacaagagtcaaatggcttgtttctaactgtatcaatctagaataagcattattccacatgcaatcatcacaagggggtgggaatgtgattgaatctatttttattatttctaaaattgtttctgggtcaaatgttatttcctgaaataaacagcttgcttgtttcttacctcagtaaagagagtgatttgctggcagccccggtggcaagtgagaccaggatctttttgctgccaattttgtatctgtggaggctattcactgcaccgatcgcatcttgtaagttttccatttgcacaacagccttgagttgataatctgtatgggggctgagctcaacactcttcacctacaacaggaaaagcgaaaactaaacgctatgtccgcccagaaccctgtcgtcttaaaactgaaggtgaaccatgaaggaacacatttgtcgactgcagcgcttccatgaaggagtatgtctgaactctgctcttctgctgaccaggacgtaagaaagtgaggatagggtgacctttagagatgtgacactggcccggcctgcctgtgtgctctggcacacacaggtttccaaggcaggctcagaggccaacacatgggaagagtgtttggggtcttttctagactctacaaaacccaggacatggccatttttaagaatctactaaaaaggtgcatttttagcaaaattgcacctaaaaaatgagtcaaatataataaggcataaacaagaccagccaacattattttagaatcctacctgtatttcagcaggaagagctaactgaaatccatcaatgttttacttatcaaattgcctttttttttttttctttctgagatggagtctcactctgtctcccaggccagagagcagtggcgtcatctcagcttactgcaacctctgcctcccgtgtttaagcaattctcctgccttagcctcctaaggagctgggactacaggcgtgcaccaccacgcccggctaatttttttttagtagagacggggtttcactcgccaggctggtctcaaactcctgacctcaggtgatctggccgccttggcctcccaaagtgctggaattacaggcatgagccgccatgcctggccacaaattgccatttcaatttctgcctaagacaagagcttttcactgctaggcgtcttgctctctggggctaacattgtaaaaactggatttatagcaccaccctgagcagaccaaagggaaaaggaaggagttcaaacttgttcagtcacacttctatcccggctgtggttatgtatatcaaattaggtcctcttgactagagactccatcagagagtataacaaagcaagcacaagagggaaaaagttaccttgccatgcctggcaaatgcttcctgcaggagctgctgcagctccttccgggataatctgtagtctatgttgctgacttggacatcagcaccatttgcaaatgggtctgggcagtcggcttcgctgctcgaatttgcaatgttgaaagcaagcggggatgctctgtttaaaaggtttggagacatactcctgcttaaaacacacatattgacattattttaaaaaactgttctgtatatttagattttatcatttaggctttgtttgaaactatatacagaagcagattttccacaacacaaccaaaccaaacatttggttttcaaatgtgtttttaatctttttttttttttttttttttttgagacagagtctcgctctgtcacccaggctggagtgcaatggcacgatctcggcttactgcaacctccacctcctggattcaagcaattctcctgtctcagcctccccagtagctgggactacaggcatgcaccactacacccagctaattttttttatttttggtagagatggggttttaccatgttggccaggctggtcttaaactcctgacctcaagtgatccacctgcctcagcctcccaaagggctgggattacaggcgtgagccactgtgcccagctgtgtttttaatcttaaatacacattgatttcagacattgtcaaaagtactatctactgacccctaattaccgccaaccaattaatatatattcttcctttgggttaaagctaaaggcaggaattagaggcagtcctgatgaattaaccttctgctttgtgcattatccttaggaaatcagcctgtgataccaatttaaggcgtctaacctcctctgtgtctctgaaagagttaaacgttcttgcctacatgttacagttctttctgcacataaggaaaacttttatgtggctttttagatgtaattttatagatccatagtcactttctctttttttttttttttttttgagacggagtctcgctctgtcacccaggctggagtgcagtcatgcgatctgagctcactgcaacctccacctcccaggttcatgccattctcctgcctcagcctcccaagtaactgggactgcaggcactcactaccacgcccggctaattttttgtatttttagtagagatggggtttcaccgtgttagccggttagccaggatggtcttgatctcctaacctcatgatcctcccgcctcggcctcccaaagtgctgggattacaggcgtgagccaccacgcccggctgatccatagtcactttctacagtgatctgccaccaactcagcagaacaaacacaatgctaaaaggagctcatgggaatgcaacacggccttacggcttctctgtctcccaagcatcaagaattccttggtgtgagagacagtgataaataattaccatggtttacagaaaactttacttccaaatagcttcctatacagaaccatatgaatcagaaccaccaatgcacggctcgtttgggctttttcctcaacacagcgaacatagggacatctttacatgcccccctgcactggccagggactctccaacaggcttctctttctgacctctgcttaccacaatttccagatggaggaagaagaaatggtgaaagcattgcccctaaatgttaacgatgattacctgaggagagggggactggcagaagagtgatgggagacttactttgtgcatttcagtactatctgaattcttttcaacaaacatactatttcataatccttcctattacatgtaaccacccccatgggtcaagaagctggactcacctagaagaccaagactgagatgcgagcagaggactgacttgcctggatgcaactaacttgctaaaagcagacgggtaactcacttggaatacagtctcctctttatcttttttctctacaggagaactggtaacacttcgggcactgaggttctcctttctaacagaaggggaaaattgaaggcaaaaggtcatatgtcttccttcacattcaagaagcagctatgagaaagagtagtttcacatacttctgactggttttgtaaacgggttctgccacccccgagtttttcggcgtcgacactgcagcacttgagttaccgtgagtgggtacgaccagcctcaggtgaccttgctggtgctcactgtttctatgaccagtttttgactccatgcggcacagctccttcaaagacacaagcacagtggggtttaaattttaagtacccaagatgtgttagatcctttacagaaaacgattgactttgagtatcatcaaacactgaaatcaaaaagggacacgccaaaagcaagcgggcacgtaaaacacagaaacaaaccaaacctaccataaacttcagaaagcaagaggtatcaaaattacctgtaaacttttaacatttgtattttttgtagcagatccagaatttgcctgtgacccttttccaggcgtggctttggcactggaagattgttcacttgcatctttgatgaggcacaattttggattcttaagttttttgggagacttcactttatcagcaattgcatttgaactctttgtttcacagagttctctattttttggagtaaatgacacaatgatcctattaccaaagacatcttcgttttccattcgcttctgagcgcgctctgcactatcttggtttatgaagcggagaattgcactgcagcctgtgatactcagcactttcccaccacaattatcggacaggcgtctgagcctgttgctgacgctcttgccatccttatttgctggtaggttataaacatagagcagagtgtggcactgctaatacagaggaaagaagtgttacgtcaggttaattcaagggcacacattcaatttcaaaataagaacaatgggtgacctccaaacttcagttaacaactttgaagagaagatgacagtgatttagatgggagagggtaaattatttagtgttgacaaagtaactgaatattgttttaaagaatatgctttagctgggcatggtggtgcatgcctacagtcccagctactcaggtgggaggattacctgagcccaggaagattgaggctggagtgactgtgccactgcactccactctgagtgacagagtgagacactgtctcaaaaaataaaaataaaaaagaatatgctaggcacagaggtctgtatactatatgattccatttctataaagcatccagaaaatacaaatctacagagacagaaagattagtagtgcctgggagtggggaaggggattaattataaattagcataatagatttactgaggtgacaaaaatattctaaaattgtacaactcaatttactaaaaattattgtacacttaaaagagctgaattttgtaatatgtaaatcatatctcaacgaagttgttttttaaaagtctatttattctgcaggtctgctgaataataacttatagagccagaaggtgagcagggtcagtcctggttggtttttgcataggagaatgcctgggaatactaggagctataggcttaagtaaacaaaaatttttttaaaacccaacaatttagagcctgttcagcttcaacagcagattgccagtagttaggctggaagttttatttggcagtgggtagtcataattcttccagataagttgaaatttatgtattaagaagtagaacttggcctggcacagtggctcacgcctgtcatcgcaacactctgggaggccaaggcaggtggatcacctgaggtcaagagttggcgaccagcctgaccaacatggtgaaaccccatctctactaaaaatacaaaaaaagttagctgagcaaagtggcagacgcctgtaatcccagctactccagaggctgaggcagaataatttgcctgaacccaggaggcggaggttgcagtgagctgagatggcaccactgtactccagcctgggcgacagagcgagattctgtgaaaaaaaaaaaaaaaagaaagaaagaaagaaggaagtagaactggagaaaaagaaagaaaagagagagagagagagaaagaacgaacaaacgaacgaacgaacgaactggccaggcatggtggctcatgcctgtaatcccagcactttgggaggccgaggcggggggatcacttgagcccaggagttcaaaaccagcctgagcaacacagtgagaccccatctctattaaaaatttttaaaaattgccaggcattgtggctcactcctctaatcccagtacttagggatgctggggcaggtggatcacttgaggtcaggagttcaagaccagcctggccaacatggtgaaacctcgtctacaaaaaactagccagaggctgggcacggtggctcacgcctgtaatcccagcactttgcgaggccaaagcgggtgatcacctgaggtcagaagttcgaggcaagcctggccaacacagtgaaaccccctctctactaaaaatacaaaattagccaggcgtggtggcgggcgcctgtaatcccagctactcgggaggctgaggaaggagaatcaattgaacccggcaggtggagtctgcagtaagcggagatcacgccactgcactctagcctgggtgacagagtctcaaaaaaattttttttaaataagaataatattttaaaaagcagaaccattaaagcaccaggagaaaacttaagataattatataaagggttaaatccagaaaccataagagaaatcactaacaacaggcaaaggatgtgaacaatttacagaagaaataaaaagcaaacaacgataatcataaaaggatattttgcactgtgttaaagattaaaagtcaattataagatgatgctgtttttcacttactggcctggcaaacatttaaaacagacactcttatgagtgtaaattagtaccaccttcctggaggaagacatggatcttgctagtaaagttctaacccagaactcttatgccttggaaattaccctatggtatgtcagcccaggagcctaaagatataaattaccttgctggaaatggtaaaaaacaaaacaaaacacaaaactgggtataaacaaaatgtccactaacaggtagactggttaaataaagaccagccatacaagtacttttcaaaccaaagttctggtttttaaaatgtggcagatttatattaatatatattaacatgaaaagacatccaagctctgacatagtttttttccaaaagccacagaacactgtatatgtgacacatttttttttaaacgtacattttttaaatctggagggcaataccaaaatattaacagtggttacttctggagggtagaattgtggggttttcactttccacatttctaaatattgtgttttgtttgtttttacaatgatcataccatactattcttttctttcttttttttttagattttttgagacacagtctactctgtcacccaggctggagtgcagtggtgtgatctcggcttactgcaacctccactttcaggttcaagtgattctcctgtctcagcctcccaagcagctaggactaccagtgcccgccaccacacctggctaatttttgtatttttagtagagatggggtttcgccacatcggccaggctggtctcgaactcctgaccttaggtgattggtgatctgcccacctcagcttcccaaagtactgggattgcaggcgtgagccacatcactcggcccacaccatacttttctaatcagaggcttttctttttatttgaggggtactgaccaattatcaacaaaatctacacttttcctattacacctgggactcaaaacccaggcagtaccaatgtatgtttaatttattaaaattaaaggaacagactaaagaacataaaaagaaatgtatcttaaattatcactctagtggatgggaaaaaacatccagcaaaactaaatggtttgaattatcaaaacattgttttggtttttttaaccataaggaataagaatctccaaagtgggcaagttcttacctaaaacactacatttacttttttttttttttttgaaacagagtctcgctctgtcgaccaggctggagtgcagtggcgcgatctcagctcactgcaaccttcacctcccaggaaaaaacaccgtatttacataaggccttcaaagttagaaaagtgaccgtcaaacagaagcagaagggaagaaatgtaactacagccaagtgactaaaaacaaataatgacaaaggtgagttaggaaagagcctcaaaagattaaggtaaggcctgtatatgcttactccctgggtaagcctctggtatccacaactctcaactgtccatagcatgagtttcaacttaagccagaccgcagggggcttgttgggtatcggggacacaggtgactagcaggcaagtgccggaatcaggatacccggggcccactctcttaactgctgcaatcaccaatgacacgtttactttttctaagagctgatttctttctcccttaaatgaagactttgcatgagatcatgtctaacgtacttctgtaactctcagttattaaattatatgtgaagactttcatttaacgtatgggattgcccactctcctggatcacccacaccatggctccttctccattatcattaattctttcagagttacacacatattcgccagcggcttaaacacagcccagcactgcaataaacattcttatcccaagtcaagtctatcagaaatgctagtcctggaaatgtgctcacaccctcctcccagtatatggcataaacaggctacacacaggtggagcaataaccactcctgctaattgtgtccatgcaccacagggaatgcacaatagaaagcacagactcagaggcccgctgaagcttaaggattaaataccgaaaaaaatgcacaattgactccacttatttggtgccaaccacacaagtatgtgagaaccctcgccatattctctacccataatacttggaagcaaaaagaatcatgacttttaatccgttatttctatccacctgacacaaaacactgctagctttgaagacactggcaagttgggaaggtaaatctacaagtcaatttcatatgatattttgaaataaataaaagcaaacttcatacataccaattatctgtatatttgtgagaagaaccgaaggtttctaagccttacttcaaaatctaacccacctcttacaaagaacagccccatctgggcctggcaacccccttattatgggctgtctttcagcctccacaatgtaatattggaaaatggcaaaaataacgcaaacccacttactggcatttttagtggtaacctggggggcaagtcggaaatgaactcttcaaatctgatcagctcgttagcatgatgcagcagtgcttctgaggcctggtttttatggaccaaaataatgtggaaaccatgcctgtgtctcaggtcactaagttccaatgcaaaattgacatcagctgaaagaaaaggtacagaccaaccccatccccaaacattagaaacacttgacaaagacagacaactctattgacacccactgagaagaaaggaaaggctggactatattcaaaattgcttcccccgtttcttaggaaagaaacacgtttcacatcagaagaatgtaagacaatcttaccaaaagaattccaagacacatatgttactttcagtattaaaaaggagcaaatatgttggggagactcaaatttgaaaattaacttaaactttaaaaattattaatactgagcacaaggtaaaaaaaaaaaaaaaaatcacatttttctttaataaacctggtcccggccgggcgtggtggttcacgcctgtaatcccagcactttgggaggccgaggagggtggatcacctgaggtcaggagtttgagaccagcctgaccaactggagaaacccccatctctactaaaaatacaaaattagctgggcgtggtggaacatgcctgtaatcctagctacttgggaggctgaggcagaagaatcacttcaacctgggaggcggaggttgcagtgagccgagattgcgccatcgcactccagcctgggcaacaaaagcgaaactccatctcaaaataaataaacaaaaaaataaaataaaaaataaacctggtcccacaataactcaagttccaaggaggaaatacagaaatccacctagacccaattttttttctaaacagttctcaacaataaccataaacatgtctcatgtacttcagcctctttggggatacattttactttcacatgttgctggcttctatgataatttcccacacagtgagtttagctgaaattagcagatgtttctgtacttacttgacacaagaaccactgtggctggagcagtgtgtgtatttgcaaatctgcggagactctgccgcagtttatcatcagcggcattctttgcagtagcattgatgtgggcaacggttacctgcattaatttataataagggtgaataagcaggagctgaggctagaaaattgctacacattctgcccatattttttattttttaaattttattatactttaagttctggggtacatgtgcagaacgtgcaggtttgttacataggtatacatgtgccgtggtggtttgctgcacctatcaacccatcatctaggttttatgcccccacatgtattaggtatttgttctaatgctcttcctccccttcccccaaccccgacagacagaccccagtgtgtgtttttcccctccctgtgtccatgtgttctcactgttcaactcccacttataaggcaagaacatgcactgtttggttttctgttcctacattagtttgctgagaataatgacttccagcttcatccatgtccctgcaaaggacattatctcattcttttttatggctgcatagtattccatcgtgtattatgtgccacattttctttatccagtctatcactgatgtctgcccatattttaataagtaattcttgagaaaaaaattcttattactattgggaatggtaaaaaattacaacagatctcagtaatctcaacattggttcttgatatgaactgggtttgtgactaaccctgctctcatctccaatcttctgtttttgcatttctttcatcctcctttcagaaaataagtagaatataggaagtgaaatttgaactcagttaaatttgctctaatagcttctgccaacaatttggaggtggtaaagatcagacaaatgactaaaataagatttaaggctgtgttttatgtcaactgtccatgctacccatgcaagcttgtgcaatctgccttttgttgttgttttctgttttgttttgttttgggcttttagcagctggaagccatagtttttagtttccgtccctactaataagcagaaaagagagataaggaaggtgctttactagcccaaccagaaacagaaactgagaatccatgattgtattctctcccttggacacccctggatggctttcaggatctggggtgaggtggtagagagaggagggaggatatcccctaagggagctaaaatgcatttatttctgttaaaactatcaggctcgcatataagtccccaaaggaaggaaaggtttattttgagaaagttgcctcaggcacctgcaatacacaataataacttgctggtttttgtaaagaacatgggtatatcattttagacaagcaatatggactatcaatataattaattatctaagagtcaaaagacccaaattctagtttcagcttaaaagcagactctgggggtcagacaaatctagatttggatctttgctcttcctggccaagtgatcttaaacaagtttcttcacctctcagggccttagtttaatttgtaaattgtgaattatatattctacgtgcctggttcaaagagcagtaatgaaaatcaaaggaaataatacatatataaccattataccagtatagaactaaaatataaattagggagcataactgaaagaatgattaaattatttctagtactttggaagtgatcttttgctaatttattttatttgaaaacttggcacaaatgcaatatcattaaacaaattttcaatcagaattctaaaaaaaaaaaaaacaccacacacacacacacacacacacacacacacgtacagcacttttagaggccaaggcaagaggactgcttgatcccaggagtttgagacaagcctccaccacctaaccctggatcctgaaagccatccaggggtgtccaagggacagaatacagtcatgggttcttagtttctgtttctggttggaacatagggagacctcgtctctacaaaaaataaaaaatgagccgagcatgatggcgtgcatctgtgatcctggctagttgggaggctgaggtgggaggatcactggggtcccagggttcgaggctgcagggagccatgaatgcgtcactgcactccagcctgggtgacacttagactctgtctcaaaacaaacaaacaaacaaatatctgcttattcctctactgtagattaaaattattaaattttttttttttacctggcaattattcagctcttgaataacttccttgttttctttactgatgtcacatacacagatgaattctgcttctctgtggcctttaaaaaacttctcacggattctttgcacaacagcagttgctgaccggccagagggaacggagcagttttcaatatcccaaaaaactccaatggggggtaagttttctagcacctgtccagctactgcaacttctggtgacccttaagaaatgttaacattttcaattacttgtagtggaaaataaatggcaagttacaataagataataaactacctatcattctcagtggtagaaaaactaaattattaatgaatgccaagttttaaggctaccaacctcactggttgacctaataagcaatcaagctgtcaaaaagtatcactctaagagattatttctgtttttcaggagaagacaaatctaaaagtcaagtaactttaagcccacaataaatccacctccaagcatgagccactctgacattaagcagtgatgcttctctgaacacaagcacactaactgaccggatactgcagctccaggacccgactttcaagcttagcccacacttatctacctacttggtagtaaccaacactgaggagctgacaaagggtgaagctgttactgtcgttgattttgagttaacgctgcattaacatctgatttaatattttaaaaatgttttcaaaacgtcgcattaactactttttagggaaattattttaactgagaactctttggttttcaaatactgtttttaatcagccattagtaaattgttctaagcacttctagggagtataccatcaacaagtgtgatttccaacctaaggtgacaccaagtcttttccagcacttttatttctcctgatatactaccaatttttctatacacagcttctgtgtatagcctcggcccaacataaagggcaaatgacttcctggtccataataataaaaagatttctaccaagatatggaattggagactcacatacacagtagctttagaaccataaggaatccttcaaaggtgattaaatgcaatgttagtatgagatattgaaagctatttaaatatgcacattttatgccatactgtcatttaccaaattttgaagcagctttgcctagactggtcgccaataacaacgtggtctccttccctgttcctttggttccacagccattacacagagggacagcaagaggtgcaggttgagtatttggaggtggtatatttggccagactttagccgcatcgattatgctatttcttgctggctgttttaaattttttttaaaaaggaggaggtgtcagatacatcatttcagaagctggagttatatacaacaactgaaaatacactctaagtgttttacctttccacttgctagcctctaataaaaaggactttcaaataatctttccaagaaccattagctatcagttcataaattcatttccagaagtgacttgacatgatcaagaaagatattcacgtggtcagatctttacattctggggcatgagtctgctgcaacgaagacctcacacatattttacataaagggtagcaaagtctcacttgaacaccaatgtgactgaggccaagcttcaggtttcccacattattgcaaaaagacaacatgcagttatctaccttacatgaatgggcccatgtgtaagctgaatgtaagttataaaaaatccatcgtgctttagcctttaaacatagaacacgaaggctttgccaacctcttgtttgcaacaagaggctctaaaagtataaactacaaaaataatgactctctacttttttgaatgatctcccatcttaccctttgtttctttcagaaccagcaaaaattatgctgatggggagattcccctataccatgggagaatcttcaaccccatgtataatacttttcaagataaatccacttcaaaagtcattcctcaatcctcagctgcacccaacttaagaaataaaaagatacgaaccttgtttagacagtcttcgcagtaaagtgagccctttaaacaaaccggaggtaccacattaaggtgcaaagagttggtgcacaagtgaggcgttagctccgactgtgaaatgtgctcttccaaatgccctggagccccgcttgtgaaatcagaacaggggaaatagccagcggaggtgcagccctgcagactcggaaactgatgcagcttgtgcacattaccatgacatgactggaagtggagttttccacaacagggcaggtgtttgcaggaagacaggttactctctagacacatgctgggaaagtcacttgcaatgcctgccaaattgttcctagctgaggcattctggagtgaagatgcagactggaaagcaaaccctgaccctacctgacacgtgattgtcctggtgctttgcgagtctaacagtgcgcccgggtgaatcaagctactggtacctccgctaccgccaccaccaccaccaaaacgcattggcgaagtggagggttcattagggcaatgagcacagcagcttactttggggacagaagaaagctgtattttaggctgctgaagagaacgaatatcaggaagtgggactgctggaaaaagcttagagccagcatgaaggggtgatggtacatcctttagttccacagcaactttcttgttctccatgtactctttctgagaaaagaaaatcagaacataaattaattttatgaggtccgtggttttttggttactcatatcttactgcatgcacaaacagaaatagtgttcaattctgttacatcactaaatcataactgaacaaaatggaatcacagctagttaaaaccaggaacattcttcagagaggtctgcaggacatgaacactggaacacacaactaaaattaagactacattcttcctgaattgaaacagactggggtgggagggcctgtttacatctttagcagccaccatgcctcagtaacttccttttggtaatttccccttgcctcacagaatcttctgaagacaaaataggtggtatgaaaacaacccctcacaaacagcattcaataaagatggctaacacacacagtggtttgaggacaatacttaatagttctgtggtcaggccataaggggttttagtaagatcccccaaaggaaaagagtaaagtttcaaacacagatgagatcagccatctacccagatggcccatccgtgttgctgatgacatttcataaaccctaagatatcatgacctaaagccataatgacaattatattgcagccagtgaaaagatttagagaattagaaaactatccaagaaaaagatccaagacaaatagtttgccacatgactccaacacagacacaggaagccagtatattacaaaggttctgagcagagcatcagtggcagagacctgggttagaatctgatactcaatagttgtatgaccttgggtaagttacttaacctacactttggtttcctcatccataaactgggaatacaatatacctcctagagttgctaggaggataaaataagatagagcacatagaccacctggcacagtacctagccactgaaaggggactgaattcatcagccttcacaggctgactgcaagagacattaagatgaagagggggccctgctacagtgactgagacgtgctcaccgttcacagcatatgagggtccatctgacgcctaaaattccactccctttgctgtgattctacactcacctgggagcataggctcatctggaagaaatgtgaattttcagctaaactttccctaaaagggagataacagcaacgggctgaccagccaatgaactgccctcttggtaattatagttcagactgaaattaacacactggtattctgatttatacagatcaggctcatacaggcaggcttactatgagttgatcccctgaacctactccattctgcatgccactgacaaaattgagtttcaagatctgtaaagttgaccgtgtaattctgaattgtgtgactccatgaggaccagatctaccaccccatcccaggaagccttgcttttgatgccaaccctcactgtcaactgtctctaaaataaaacactcctaaaatgacccaaattacttgatgtcttgcaacaaagacaactatatagtgaaaacctagagaaaatagagaattaaactggtttttaaaaagttattaatacccggccaggcgcggtggctcacgcctgtaatcctagcacttgggaggccgaggcgggtggatcacctaaggtcagaagttcaagaccagcctggccaacacggtgaaaccccatctctactaaaatacaaaaattagccaggcataatggcgagtgcctgtaaacccagctactagggaggctgagacgggagaatcccttgaactagggacagtggttgcagtgaacccggatcgtgccactgcactccagcctagggggctgagccgagactctgtctcaaaaaataaaatcaaataaaagttgttaatacccttatataaaattatattacagtctcacttgaatcccacatacaatagaaaataagaaatagaaaggtggtaacatgagtgcatgaagtcaggaaatgtcaaaattggctggacgcggtggctcacgcctgtaatcccagcactttgggaggctgaggcgggaggatcacttgaggtcaggaggtcaagaccagcctggccaacatggcgaaacctcgtctccactaaaaatacaaaaattagccaggcatggcagcacaggcctgtaatcccagctactgaggaggctgaggcaggagaactgcttaaacctgggaggcagaggttgcaatgagccgagatcgcaccactgcactccagcctgggccacagagcaagactgcacctcaaaaaaaaaaaagaaaatgtcaaaatcacaatgagtaagcaagaagttagagacataaatgtatactgagaagtaaatattcaagagaaatctcgaaataaaaaacaggcagtggataagctcttcccaacccttcctagattatagactcaaaactcaagagggctacagtaaaatacaacatattttgtattttcctctgattttactccacaatgtggatttttaatctttgttacctgtgactttaatgaggaagaaatctttcccaaattttaacattaaatattcaaggcatctactgttactcaaagtgaaatagaagagttaaaaaattgtgctgtgctctcacattataatgtggtataagaggcaatacaggcaagatctacagaaaaatgtggcacagactctaggatgagagactgtatcccagaccaaatggacctctctcatctatttggatgaggaatctgctacatccttagtcttgcatatagttaccgtttggggactatgtggcagcgtctgctcaggacgagaaaagcaattagagaatttccaaagccatggcttagcatcattatcttgttgaagccatccacgtgttctactgcaggagttctcagttccgtttccttccatcatacagccatgcaaagtgattcaacatcctttcatctttcttttctttcattcttccaccctgttaagaatgagtaagatttcagtgttatttccttgcataagtacaaattttacaacatactaaaatgtgaaaccacagctatatttacagtcctatggctctcaacaattcaaatctttgtttcaagaggaagtctcgctctgtcgcccaggctggcatgcagtggtacgatctcagctcactgcaacctccgtctcccgggttcaagcgatttttctgcctcagcctccagagtagctgggactacaggagcctgtcactatgcctggctaatttttatatttttagtagagatggggtttcaccaagttggccaggctggtcttgaactcctgacctcaagtgatccaccctcctcggcctcccaaagtgctgggattacaggcattagccactgcgcccggccaacaattcaaatcttaacaaacaaaataataataataaaataaagaaagaaaaaaacacaaaatatcagagcatattacgggttaataaaatttggtaaacttggttgactgtttatgcttaaaatctaactgcaacaacctgatttcttaaaaaatctataatctgccattcttcatgtttcatagctcttcaaataaaaaatgaactctccatgagtcttgtttcctttccacatgtaaccatgtttgagagaggtagccatatcttggaaacttgcatattccagagtgagacttcacctcctcacttggctggaatcaattttttctacagtttttctgaattcttttcggctctctctccctaaagatgctgctcaggaaagtcaaaagttaacagaagagagcatctaatctgagtaaaagagccaccaccacatcctcattgacaactatatgtaagattttaaaattgacttaagagcaacttcttgcactggtttcttgatctgagcatgaaaagtccaaactaagtggcctctgtggactttgaatttgatttgctacagaacaaattgaaccaatttcttagtttactaatgatgaaagtgcaatctgatataccaccaaaaatctaactgatagaaaaatctcaagtcgcagatgtgttatatctacgccagagcaacaacactcttacaggtcttaacaataaatgcaagcgaggcaccgtggctcaggcctgcaatcccagcactttgggaggccaaggtgggtggattgcttgagcccaggagttcccaaccagcctgggcaacatggcaaaaccccatggctacaaaaaattagctgagcgtggtggtgcatgcctgtagccccatctactcaggaggctatggtggaagaatcacctaagactgcgtagtcaaggctgcagtgagctgtgattgcaccactgcactgcagcctgggcgacggagtgagaccctgtctcaaaaaccaacaaacaaaattacatgaaattaaaatgtcagtgtccataaataaagtttaattgggacacagacacactcattcacttaaatactgcctatgactgcttttgcattccaattgcagagttgcaaagagagtctctgcaaagagactgtatggcccacaaagcctatatttactacgtggctcttttgtcagcctgggcaatatagcaagatcacagctctaaaataaaataaagttcaaaaaattagcatagtgtggcagcatgcgcctagtcccagctactagagagactgaggtaggaggatctcttgagcccaagaatttgaggctacagtgaactatattgtgccactggcccttcagcgtgggcaacagagtgagattccatctctaaaaaaatttttgttttcaagtttctgtttcctcctatgcaaaatgtggctaatttctccccgccactgcattacagagaaaaaaaaaattagataaatgaaccccactgtctattttcaccactgtatctcttgtgccaaccaaaatgctccctactctgtaaatacaaagtaaacattacctactacacactattgggagtggttaatttggagatggatttaactgctaccactgatagtaaattacgattcttgtctttcctattagatacaggttttatgtcccccaaaaaactcctctcaaaatcgtaagaatctgtgatattcacagtgttcataacttaaacattctctcaaacttcttcaaagccaaatcctgaaagtgagctaacattcacagtataatctagtttataaagtattttcacttaacattacttatgtcttcattcagcaaatatttacttagtatctactatgcagcaggcctgtgcttggcacaaggaatataatgatgaaaaaaacccagacggtgggatcctcttatataatttttgcaataatcctgtgaaatagacaggggagaaattagctacatttttgcagagagagaaaaagaaacttaatgaagttttgtagcgagcctgacacaagattaggcttgttcacccctttccactacatcaaggtgccttcaatactgctcaatacaagcgattaaaagtaaaaactttcaggtgcctgcaccctgaaaacttcccaaataccatccacgaagcaacttaggtagccaaaagcaggttctgtttgacttgagcgacagtctcctttctgtcactctcttcaagtcttttgaccaattcaatgaggagagcataggctctgtcgactgtctgcattttggtctccaatttgactgcggtgcagctttggacaactcacaacctctctgaacctcagatcccatctctaaaatgggtgtgataataatagaaaccaccttacaaggccgttgtttggattacatgaggtaatccacggggaacatttagcaaatgttgtttccttagcacccaatctagtctttgaccccacaccaccccatcccattaccgttttctcccccatagctcttctgtccaaaacggcctttttagcttattttattatctttctcccccattaggctataaactccatgacagcagagactatgttttcttatccactattccaactcctgtccttagtacaatgcctggcatattttaataaataactgttgaacgaataaagcttaataaataggaaaacagtttaggtttcaatacaccgatatgcaaaagagaagaatatttaccgctcagagaagtccaaaagacacaaatgcaattggacagctcttggtaataccggaaaggtgcttgagaaactctaaaaggtgtatcacgaggtcgcgttacaactactagtgagagtggctgaagccctagacattgtcaaccctgagactacaccctatgtgttgctaaaaggccgaggagaatgcaaaacggccggggaggggggagtgtgttgcaaaaacacccgcccctttccttctctcttaaccttccagctgtgcacttcactcctggagggccccaccaggggtcagacaggggcgggcggggagccaaatgccctcgaaggggaacagcggcgccaacagtgacagtagtgaatggacccgaaagggagacaagccaactctttcgtggggggcccaactggcgcgtcccagttagctaacctcccctctccaccaccatcccaccagcaataggcggggaaagaggggacactgtcctccgtcccgccccgctggcctcggagcagagcctgccggggtctggtcgcaggactgtctgcaaactcacctctgccgccggctccacctccgctcacattccggccccgccgccttccccccgccccccccaggccctttgttttgattcccgactccgcagctcccgccgccgccgccaagcgcacccttcacttccgcttccgcaccgcaccgcccctgtcgcaaaaccgacgcccttctctcctcttcgccccgccccttcctcgccccgcctccgccgccgcgtcctgtccgcgcggggcatgctgggaaccccggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacggttagtttcaaacactttgtgttttaggtggccagatatgctgtgtggtttgctttaaaaaaaaaaatagcgccccacaatcttcacgtttccctggaataaaaaaaaatttaagactcagcaaaagggtgatttctgaaactaccagctgattactattttctgttgcaaattaggaaaaaagcaaagcacatattgtgtaagttaaatctagacacgatttaggatgtgctagctgctagctaaatgctaccttaggagtttatttttaaagtttgcccagaaacaagttgactttgcaaaagaatcagtaagtcgaaattgccaaacgagaatattttgcccaaaaaaatccttactgggaggttatttcaataggcaatccccattacgtggggattaacacatccctgtaaacatccctgtagacgggtattgtggagggcaggatcagacatgtagctgaagaatcctttgtgcctgtatttaattttccagaaggcagatgacaagcacacatcctctccctgcgtaggtatttattactgctgactaaatcttgactgtgggctgggcgcagtggctcaggcctgtattcccaatactttgagaggctacggagggaggatctcttgagcctacaaatttgagactagactgggaaacggtgaaaccctatcactatttagaaaagaaagaaaaagaaaaaaatcttcattatgtctgtgtataggtagtattttccaagtggagattagaatagatgaaaaacccgtttctagcgttttggcttttttcaaagtaccaaacaaatacgctactcttcagaggtgttttttccccattttatttcagttgagtatgtttcaacacaagccatattaactaaaaatcttaagaaacaaggtaattgtaggtttctaattgctttttttaaaaaatagtttttagccagaaaacatcaaagaatgcagacacatttcctttttactttttttttttttttttttgagacaaagtcttgcttcattgcccaggctggagtgcagtggcaggatcttggctcactgcagcctccacctcccgggttcaaccgattctcatgcctcagcctcctgagtagctaggattacaggcgcccaccaccatgcctggctaatttttgtgtttttagtagagacgggatattgccatgttggccaggctggtctcgaactcctagcctcaagtgatcctcccgcctcggcctctttaggattacagggctgagccaacgagcttgaccacattttctttatatgtatatttttcttttagattcctttttaccaagcagacacattttgtttgacttagcttggcattctttcaagtccaaagctgtaactagtcacaacaagtaaatgtagtgattgaaaatgggcggggcatggtgactcatgtcgtaatcccagcactttgggaggctgagacaggaggaccccttgaggcttggtgtttaaaaccagcctgagcaacatggtgtgacacttgtctctattaaaaaaatttttaaaaacaaaacagtcgtattaagtggaaggctaataaaagtctgaattacaaatacttttaaaagaaatgtaattttattgctgctttctaaagactaggagcctaagcaaagtataccaggccttaggagacaattatgaatcaaaatacataaattttctcttaagatatattttaagtatgtatcctctattaattgtattcctgtttctttgctgggaaaactttagagagtacaagtaactttcagtttttcccttgtccaaattatagtcttcacatgtatgaaaaccgaaagacttttttgtgtgctatttaagtagctactttacatgcaattcagcttttcaactaaccaagctgttattaaaggagtttctccccagaaaccaatcttctacctgtattaggttcagtggtttgaattaataaatgatcatggaaggacctaaggaagttaaattgagttatctgctcagccatagtccaaagctacaaggaaaacaaattgaatttaaaaagaacaagaaaaacattttaaatgtttttaaggttttacccaatgacaaacctatttccctaaatgttgttcccaaataggactttaaggattattatttcaatgccctctcttttttctttatggaaaatttgggaaattgagaaccaactagtttaaataccttgatcaaagccatttaggcaacaccagtacctcatcagtttgtgcttcggtttctctgtaagctgaggtgattagttcctgtccagaaacgtcacagagtggttagggccaaataaaattccgaggggggccaggcgcagtggctcacgcctgtaatcccagcactttgggaggccgaggcaggtggatcacttgaggtcaggagttcgagaccagcctggccaaaccaacatggtgaaaccctgtgtctactaaaactacaaaattagctggacgtggtggtgcacacctgaaatcccagctactcaggaatctgaggcaggagaatcgcttgaacccaggaggaagaggttgcggtgagccgagatcgtgccactgcactccagcctgggcaacagaacgagactccgtcaaaaaaaagaaaaaaaaaatccaaggggggttaataccagctacttggtaggctgaggcaggagaatcgcttgaactggaaggtggaggttacaatgagccgagatcgcaccactgcactctagcctgggcgacagagtgagattccatcttaatgaataagtaaataagtaataaaattcctaaggggaggcttggtgtggtggctcatgcctgtaatcccagcacttttggaggctgaggcgggtggagcacttgaggtcaggagttcaaaaccagcctggccaacatggtgaaaccctgcctctactaaaatagaaaaattaggtgggcatggtggtgaacacctgtaatcccagctagtcgaaaggctgaggcaggagaatcgcttgaacccgggaggtggaggttgcagtgagccgagattgcagcactgcactctagcctgggcaacagagtgaaactctgtctcgaaataaaataaaattccaagggggaaggcatcagacgtagtaaagtgtgaagcagcatgtaaatgattcattaatgtttgggaagtttcctgaaagacatttggtactttccttaaacctgttgataggtggtggggttcccctttgtgcctctaagcagtttttaggaattagcaaggagttcaaagtagaatttgagaaaggctgttgtaggatagcaggaaggcaagatggggtgggagatcctgtaatagctaagatctctttgcctctagcatagtgctgaagaaggagggtttaggagtcagagccagctctgaagcctgatttgttaattactagttgtaagacctcggacaactcaattaacttcctgcacctttattttcttatctttaacatggatacaatttaatgctttcctgtggttcatcacctgtggttcagttgcatggtctcctctctacagtggccttccctgactatagcatctgaagtgacccctcccagcccgttgtatcaaatgggcttgccttagtcatagcacttatcagtatctgaaatgacgttactttttctgcttatagatttagtatgtttctctcttaacaatataagccctttgaggacaggtactttgtctgactgtattcactgtgctgtaagggtgcattgtacagaagaatgctcataatgccgggtgctgtggttcatgcctataatcccagcactttgggagggaggctgaggcaggaggatcacttgagcccaggagttcaagaccagcctgggcaacatagtgagatccacgtctctacaaaaaaatgtaaaaattagctgggcgtgttggtgcacacctgtggtcctagctactccggaggatgaggtgggaggatcacttgagcctgggaggtccaggatgcagtgagctttgattatgccactgcactccagcctatgtcacagggtgagactctgtctcacaaaaaaaaaaaaaagctggataataatatatatatttttagtttttatgggtacactgtaggtgtttatatttatggggtacatgagatattttgataacaggcatgcaatgcatcataatcacatcagggtaaatgggtgtccatgacctcaagcatttatcctttctttgtgttacaagcactccaattatactcctttagttattttaaaatgtacaatacattgttgtggactgtagtcaccctgctgtgctcccaaatactagatcttattcattctaactctatttttgtacccactaaccagaatgttcggtatttgttaatgaacatgttatgacaggatgttttagaagaaaataaagaaaaaaagaaattccagccaagcatggtggcttgattttatttatttatttattttgagatgaagtctccctctgtctcccaggctggaatgcagtggcgtgatctccactcaccgcaacctctgccttctgagttacatggctcacgcctgtaatcccagcactttgggagactgaggtgtattgcttgaggtcaggagttcgagaccagcctggccaacacagtgaaaccgtgtctctactaaaaatacaaaaaattagctgggcgtaatggtgggcgcctgtaatcccagctactagggagactaagacaagaaaatcgcttgaatctgggaggcagaggttgcagtgagccgagatcgcaccattgcacgccagcctgggcaacaagagggaaactctgtctcgaaaagaaaaaaattattttttaattttaatttgttagtgaacaattagggttgctgtgagaattgtgcctggcacacacagccatttaaaaatcacgatcttcaggcagtgtgtggtggctcacgcctgtaatcccaggactttgggaggccgaggtgggtggatcacctgaggacagggattcgagagcagcctggccaacatggtgaaaccccgtctctactaaaaatataaaaattagccgggtgtggtgatgcgggcctgtgatcccagctactcgggaggctgaagcaggagaattgcttgaactcagaaggcagaggttgcagtgagtggagatcacgccactgcattccagcctgggagacagagggagatttcatctcaaaataaataaataaacaaaatcaagatcatttaacaaatacatatattgtacttactaagttcaaatttctgttctaaacgtttttacaaatgctgttaagtcatttagtcctctgcataatgtcgtttgtttgtttgtctgttctttaagacggagtcttgccctgtcgcctaggctagagtgcagtggtgtgatctcggctcactgcaaccgccacctcccggtttcccgtgattctcctgcctcagcctcctgagtagctgggattacaggtgcgtgccaccacatccggctaattttttgtatctttagtagagacggggtttcaccatgtgccaggctggtcttgaactcctgacctcgtgatccacccgccttggcctcccaaagtgctgggattacaggcgtgaccaccgcgccagacccataatggcgttttatagatggggaaacggagtcatagaggctaaacaactttcccaagaccacacagttagtaaggggcaggactaggactcaaagccaagtttatgaccaaattctggtgcactacgttctcctgcttctggagaagataatgatgctgaagattctacttttggtgtaaaggagtaggaagggcacggggcactgctagcttcagtgggcctgaatctttgtctttccttctgatttggagaaagtgcaagaatgggaaaatgcaatcgaagtgaaggagaggccggcgtattttcctgaaatgcgcggcccgcaagcccaaacccgtttcccgggtgtccaggcagcgttctgcagcatctccaatgcccgccagcccgccgcagcccagcgcccggcagccggcgcctctcaaaccccctccggccaggagccttcgccgcttggccgcgccgcgcccggcctgggaaaaaagtttccaaacgacgctgctctgcgctgattggccgaggcggacgcggtaccgtagagcagcagccaatgggaggcgccgaccgcaggctccggggcgggggcggggtccggagggccggggccgcaccgcccttcgcagccgcctctgccgccgccgccgcgttggcctcgccgcccctgctcgggtaagtgaggcgctgcgcggggctggggtcggggtggctgtccggggacctccaccgcggctgaaaagctcctctgccccgccccaggatcccgggaccccgggccaccgcctggcagggacccctacgcccctcgcttgcgcgtcgcttcccggccgcctggactcccccggtccctgggctccaaaatcccgcctccctggagcctcccgtcctaaaaagttaggcactgagtgccttgccaccggtgcgttcctcgcgctggcccctcgcccttggcaactttgtttctctttctgcgttggtctctctcccaccccgttgccctcttctccttccgggacttcctgggtggttaagccttgccggtccccaaaccccgctgccaggctccatcctctttctcctcttccttcctccccatactcctctcctagatgaccctcgtttcttttctctctctctcctattcctccatcctgccacccgcttctctgcgaccccagacccctcgattgcagcgttgcccctgccctcacacccactgtcccgcccctgcaggcctctttccaaaaacccaccctgctccctccctccgggaacacgtttggggcagtctgctctccgctttgctcccgtctctgccgcaggacggttcaggtttcttctgacagcactttggggagggattgggtaaaggacgaaaatgcttattccgcagcttgagtgatggctgggctcactgaggacctgagtctctgaggtcctgggaaaccccgctgtcaccttgacaccgcttttggggaggcgactttatcttctccgagccatctcaggctttctgcctcctgagggcctgagcttccttgattgctttgtccgtggttactaccaggttgtgcctcttaatttctactttgagcctcaggccccttttaactttctaaagaaaaggcctttgcagcacgacctaggcaggttcatcatttttagttttgttatagtgtattctagcataggatggcattttaggacatgggtcgggtgttttgaagattaattagatcccagctactcctaaagcctcttgttacccgaccaccccagcctccatcacctcgttggtatacaacccgtttttttttttttttttttgtttttgtttttgagacagagtctcactctcgcccaggttggagtgcagtggtgcgattttggctcactgcaacctccgcttcccgggttcaagcgattctcctgcctcagcctccggagtagctgggactacaggtgcgtgccaccacgcctggctaattttttgtatttttagtagagatggggtttcaccgtgttagccaggatggtctcgatttcctgacctcgtgatctgccccctcggcctcccaaagtgctgggattacaggcgtgagccaccgtgccggcctacaacccattttgagcctttcctcttagtgtgtgttttgtgtaggattaaatgcagatgatctgtgccgctgaagtctcaggggcctgtgattcatatattttatcccatgttggataacagtttattaacttgacttatttttgtttccaaagtgtgttatttattatttatttatttatttattttgagacggagtcttgttcttgtccaggctggagtgcagtggcatgatctcgactcactgcaacctcagtcctccgggttcaagtgattcttctgcctcaccctcctgagtagctgggattacaggtgcgtgccaccatgcccggctaattcttagtagagatggggtttcaccatattggccaggctggtctcaaacttctgacctcgtgatctgcccacctcagcctcccaaagtgttgggattacaggcatgagccactgcacccgactctatcattattattattttttatgtagaggcagaatcttgctttgttgcccaggctggtctcaaattcctgggctcaagcagtcctcctgccttggcctcccacagtgctgagattacttgcaggcatgagccactgcatgcagcccaaagtgtgttcttttgccttagaatgtgagccgagaattgacactccttttcctcacaaggtaatttcctaacatgagcattcctgtgtacagaaagtttgtgcctgcagttagtactacacgtgcacctcgtgcaatggatgtgggtgctttttgtctgcctccttcagcagtgcccagcacttagtaggtattcaagaaatgtttgaaaagggttggaggaggcaaaaccacagtaggaaaaattctttccctgtcacttggttcagtagaataaaattatcctggaacaatagctattttactttttgtccaagtttttgtttgtttgttttttgagacgggatctcactctgtcgcccaagctggaacacagtgatgcaatcacagctcactgcagtctcgacctctcaggctcaagcaatcctcttgcctgagcctcccaagtagctgggactaaaagcacatgccaccatgcttggctaatttttaaaattttttgtagagattggggtctcactatgttgcccaggctggtctcgaactcctgggttcaagcgatccttccgcctcagcctcccaacgtgccggggtgggagagagccaccgcgcctggcctaagctttttaaaatctctaaagcgatctatgcttactgtatatatgtgtatgtagtttaccttaaagcaaggtgtcaggtacaaatccacagggcttgctttacccccattctggtgcatcctccagacccttttctattctgtgtacagagagagggaaataaacaaaaatgggcacccatttttaacatatcctgagctttcttccatattagtacttacagttcttaacaactgcatcgttttccattcagtcctctgttgacattgaggtttccagttttccacattcgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagttttaaaatcagaggtgtgtgtctcgagtgtattttcagacttttttgttagctttaatcatgtaaaacatgcaaaaaaaaaaaaagcatgtggaaacaattttttttttttgagacgggttctcgctctgtcacacaggctggagtgctgtggggcgatctcggctcactgcaaccaccgcctcccatgctcaagtgatcctcccacctcagcctcctgagtagctgggaccacaggtgtgcatcaccacacctggctaatttttttgtgtttttggtagagatggggtttcaccatgttgcccaggctggtctcttatctgctgacctcaggtgatctgcctgcctcaccctcccaaagtgctgggattacaggcatgagccaccacacccggccggaaacaaatttttgaaggaggcatagatctctgttgtgcaaaatagatactttttgtaccactgggtcctagtttgtcattgttccttgcatgatcccatcagatttgtctacagagctgctggggcatgatggtgtggtggcgtattaagaacgcaggttagtggcacacagatgaaataaatgcatgtggggtgcatttttaagatagcaggtgcaaagttgtatatactgagaccaggcattaacacttgcctattacagtgccttttaaaacactatgtgagggccgggtgcaatggctcacacctgtaatcccagcactttgggaggcctaggtgggcagatcacctgaggtcaggagatcgagaccagcctggccaacgtggcgaaaccccgtctctcctaaaaatacaaaaaattagccagtcgtggtggcatgcacctgtaatccgaggtactagggacgctgaggtaggagaatcgcttgaagctgcgaggcagaggttgcagtgagctgagatcacaccactgcactccagcctgggcaacagagaaagagattccgactcaaaaaaaaaaaaaacaaaaaaaaaaaaaacaaaactggaccaaatgaaacaagtgaatctgatctgcagtcagtcagtttgcaacccctgggaagccttggacttgaatgcaaagatcccttgaacttggatctagtttgcctctgctgctcacatgcacatttagagatggccaaggcatacggtgtttctgcttccaagaaacagagtggttgtcctgtttagccatctcttacagtcacacagcttaaagaagataatgtttgcaaacaatttttgaaatgtctagcacacagcaaacagaaggtcaaattcagtacttaatgctgataaaataagagaacccttgcaagtcatgttgcctgctttctgccacagagagtactgcaatagaactttctgacgttttcatgttgtttatttatttattttttgagacagagtcttgctcttgtgcccaggctggagtgcagtggtacaatttctgctcactgcaacctctgcctctgggttcaagcaattcttgggcctcagccacccaagtagctggaattataggtgcgctctaccacacctggctaatttttgtgtttctagtagagacagggtttcaccatgttgcccaggctggtcttgaacccctgggctcaagcaatccacccacctcagcctcccaaagtgctgggactacaggcgtgcatcgtgacgccctgctgatttgtgtatttttagtagagacggggttcaccttgtgctggtctcaaactcctgggctcaagcaatctgcccacctcagtctgccaaagtgctgggattacaggcgtgagccatcgtgcccggcctctctctgacatttttgaatggcaaaggcaaaaatcttatacttttaaggatgtggagaaataggaacacttttacactgttggtgggactgtaaactagttcaaccattgtagaagtcagtgtggtgattcctcagggatctagaactggaaataccatttgacccagccatcgcattactgggtatatacccaaaggactataaatcatgcttctataaagacacatgcacacgtatgtttattgcggcattattcacaatagcaaagacttggaaccaacccaaatgtccagcaatgatagactggattaagaaaacgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaacgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaagaaaaagaaaaaaaaagattgctgttttatgataaagtgaagtgcagctgttacttcttccttctttgcttccagcatctctcttccctaaggattgcttttaaaatgtaagagtttttggttgaaatgctgttcctgtggtttttgtctcttggttggagtgaaagattttgcaggctgtgatacaaatccagttctctgcttattttctcctcagtccttgaaatccaaaaccagatccctcccattggcccgttgtaattagaacctgccccacaatagacgcacctcctaaagcatctcagattcatttctttcctgaggattaagtttttaaaccttcctggccaagataacagtgttttaagaggctcttttcttttattattattattattattattactcttttctttttttgagatggagtcttgctctgtcacccaggctggagtgcagtggcaggatctctgctcactggaacctccacctcccgggttcaagagtttcttctgtttcagcctcctgagtagatgggattacaggcatgtgccaccatgcccagctaatttttgtatttttagcagagatggggttttaccatgttggccaggctggtctcgaactcctggcttcaagtgatctacccgctgtggcctcccaaagtatcaggattacaggcatgagccacagcaccctgccaggcttgggtgttcaaggaagagaaagaaggcagtgtggctgggacataagtgaatgagaggtggtagggtaagaaatgtgtagaaaactatgcaggggcctgatcacattggatcttgcacatctttttccaaacctcaggaggagtcattctgcttttgttgttactggttcctcacttccgcactttattgtatgctgacaaccttccataccatgggactgagactgccctcaatagtatcaccaatgtctttttttgttttttttttttgaggcagagtttcactcttgtcgtccaggttggagtgcaatggcgtgatcttggctcactgcaacctccgcctcctgggttcaagcgattttcctgcctcagtcttccgagtagctggggttacaggagcctgccaccacacctggctaatttcttgtatttttagtggaaatggagtttcaccatgttggccaggctggtcttgaactcctgacctcaggtgaaccacccgccttggcttcccaaagtgttgggattacaggcatgagccaacgcacccagccaccaatatcttaatggccacacagtgctcattgatagatgccttggccctgggctattgttgctatagaattggtttgatgagtacatattacatgagatctgggctcattagagcttatggcttgagcagggactccttggcctaggtttatgctgctcctggccttgttaatgactgctattaacactctaccccctttttatttttttgagatggggtcttgttctgtcgcccaggctgggaggctggaatgcagtgatcttggctcactgcagcctccgcttctcaggcttaagtgatttttcctgcttcatccttctgagtagctgggactacaggcacgcaccgccgtgcccgtttgatttttgtttttgtttttttagtagacacggggtttcaccatgttgcccaggctggtctcaaactcctgacctcaagtgatctgtctgcctcggcctcacaaagggctgggattacaggcatgagccattgcgccaggcaccactctacccttttgactttgagcaagtaaggtcgttgattccatacattcattaagattcctgcgtggcagaaatctaaccccaactggtataaccaagacaaggaattgattatctcataaccttaaatcaggtgtggctgcatctaggtgttcaaatgatattgtcaggacccaggctctccatcccttggcccagctttcctctgttttggcttcactctgaggcaggctctcccttgtgatagcaagatgaccaccggcagtttcaggcttacctccggcttcaggcttacctccagcttcaggcttaccttaccaaccctagtggaaagagagtttcatttttgacagctatgcaaaaggtctggacctgggccctcactggcttagtatgggttaggcccatccttaagccaatcattggctcagcatgggttagatccgtgactgtcactggctgagcatgggggttaggctcaccctatcattggctctgcgtgaattaggcccacctctgtcactggctcatcgtgggttaggcccacccatgagctgatcactaaggtcgtgaataggcatatgcctcttcccaggtgtggaggatgatgtcagatccctctgaactcatgaaatgagtagggtattctcccaagggaatattgtgctgtcacagaagatggaaaaatgaatgcatgtctggaaaaaacaagcaaaactacaaatcattagctttatatgacatttatttattttttgtttatatgtttttgaaatggagtcttgctctgttgcccaggctggagtgcagtggtgtgatcgtggttcactgcaacctctggctcccgggttcaagcgattctcatgccttagcctcccgagtagttgggatcataggtgcctgccaccacacccagctaatttttgtgcttttagtgtagacaggattttaccatgttggccaagcttgtcttgaactcttgacctcaagtcatctgcctgcctcagcttcccaaagtgttgagattacaggcatgagccaccacgtctggccagctttgtatgacatttcgcctttctgccttgatcaaactttcagagaatctgctttccagagggatgagtgggtcgggaaatagcatgttttctctgaatgagggaaaggattgaaaaagtaggagggagaaaggatgtgaatatgagtcccaacaaatgcagagttatcggtaagttttgtgcttgaatctaggtacaattgtgcatttcctggttctgcatgaattaggcccacctctgtcattggctcaacatgggtgaggctcactaacttccaccagaagttagtggtggtgtctgtgttgacacttacatgtttagcctaatgatttcatgttttaaccaaaactatatagcttgttggttatatcttagaaagtgatggtttttgctcattcttttgtccccagggatacacaccagcctctaagttctcttgagggaaggaagggaccttgcacacaatctttttttttttttttttttttttttttttgagaggaagtctcactctgtcacccaggctggagtgcagtggtgcgatctcggctcactacaacctctgccttctgggttcaagtgattctcccgcctcagcctcccgagtagtggggattacaggcgcacaccaccatgcccggctaatttttatatttttagtagagatggggtttcagtgtgttggccaggctggtttcagactcctgagctcaggtgattcacctgccctggcctcccaaagtactgggattacaggtgtgagccactgcgcccggccttggacacaatcttttttttttttttttttgagacggagtctcgctctgtcactcaggctggagtgcagtggcacgatctcagctcattgcaacctccacctcctgggttcaagcaattctcctgccttagccgcctgagtagctgggactacaggtacctgccactgcgcccgcctaatttttgtatttttagtagagatggggtttcaccatattggccaggctggtctcaaactcctgaccttgtgatctgcccgcctcggcctcccaaagtgctgggattacagatgcgagccactgagtctggcctggacacaatcttacttggattcctcatgcccttttgacaagctcagagcctcaaataaattcagaaaataggtgattacatcaaacagcctctatcaacagggagtatacaaaccgttagcccaactgttaatagaagtctgctttcttgctgggtgtggtggctcacacctagaatcctagtgctttgggagtacaaggcaggaggatcgcttgagcccaggaatttgagaccagcctaggcaacatagtaagaccccatctcttaaaaaaaaaattagcttggcgtagtggcctatacctgtagtcccagctagtcaggaggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatcgctttcctctttttcacctcccagttactcctgcactcagttcttcgtctttcctcctccactgtgtagaaactgttcttgctcacaccgccagtgaccgactttcgctcagccttgtggatattttccagcccttatcttccctgcttctctgttgcatccttgtgacactggaatgtttcccttttttcccttgaaaccgcccactcccaggacagcacagtcttcctgattctcatctctctcactctgtttcttctctgcctccttcggttaccatttcttaaactgcccacctttccaatattggcattcttcactgttccatacacagtccctaggcgattcttccatggtcacgaggaaaagagaaaaaccagctatagacgcatgactttcaaatggatattgttgacccaatttcaaccctgagtttcagctgcgatattgcatcttggtgtgtcatggacatgtcaagctgtgaatgtctgagactgggtttgttatctctccttaacccacccacctacccaagagttttacttgttttttttttttttttgagtctcgctctgtcacccaggctggagtgcagtggcgccatctcggctcactgcaagctccgcctcccgggttcaagccattctcctgcctcagcctcctgactagctgggactacaggcacccgctgccaggcctggataattttttgtatttttaatagagacagtgtttcaccatgttagccagaatggtcttgatctcctaacctcgtgatccacctgcctcggcctcccaaagtgctgggattacaggtgtgagccaccgcgcccggccgagttttccttttgattgtcctttttttttgagacgggatcttgctgtgttgcccaggctggagtacagtggcatggtcatgggtcactgcagcctcgacctctccttgcccctcatcctctcgagtagctggaactacagacacaccaccatgaccagctagtttttgtattttttgtagagatagggtctcaccaggttgcccaggctggtctggaactcctgggctcaagcattccacctgctttggcctaccaatgtgctgggattacaggtgcgaggcactgcacccagccaccttctggaagtctttatctctggtgatggggatggtggcggcacccaattgcctaaggtagagccccagaagatgtcctcacctcctttttctctctcccctgccccgaaaagtcataattcatcaagttctggtaagtttgccttctaaatatttttggagtccatttctgttccctccatcttcattcctactttctttttttttagacaaggtctcactctcttgcccaggctggagtgcagtaccgtgatcatagcttactgcagcctcaaattcctggactcatgtgatcctccttcctcagcctccagagtagctaggactacagatgtgttgcaccacaccagtctaattttttaaaaagtttttttgtcaaggtagggtcttgctgtgtttcccaggctggtcttgaactcctggtcccaagtggtcctcttgccttggcctcccatagtgctgggattatacgtgtgagccactgtacctggcctattctcactttctaattcaggccacgttcctttctcttttcttttttttttttttttttttgagatggagtcttgatctgtcgcccaggcttgagtgcagtggcgtgatctcggctcactgcaagctctgcttcccaggttcacgctattctcctgcctcagcctcccgagtagctgggactacaggcacctgccaccacgcccagctaatttttttgtatttttagtagggacagggtttcaccgtgttagacaggatggtctcaatctcctgacctcatgatccgcctgcctcggcctcccaaagtgctgggattacaggcatgagccaccgtgcctggtctcttttcttttttaaataggatctcacttcatcacccaggctttagtgcagtggcactatcttggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgctgggattataggcgtgagccactgcacctggcctccaccttcctttctttcttgcattgctgcaggagctccccatcttaggccttgtccttcctctgcctgtccatggccaccaggaccagctttttaagcaggagagcccatcatatcacatcactctcttccctaactttctccaatggtttcccattgccactaagtttcttaacatcttgcaaaagccgtctgtgacttagcccctttatttcagtctgtccaggtaggttcccttccactcgtcacctttcaacccaggcttaccagactccctctagctcccctacaagtgcctggctgtttctcctcattccttcttcccctgctcaattaccattgccttccagttctttcatattcttttttttttttttttgagacggagtctcattctgtcgcccagtctggagtgcagcggcacgatctcagctcactgcaacttccacctcccaggttcaagtgattctaccgcctcagtctcctgagtagctgggagtatgggtgcccgccaccacgcccagctaatttttgtatttttttttagtagagacggagtttcaccatattggccaggctggtctcgaactcctgccctcgtgatctgcctgcctcagcctcccagtgtgctgggattacaggcgtgagccactgcacctggctttttcatattctttcacatgctcctcatgtgtcgcctcttctaggaagccttccttgactttcgggttgagttttgaacttcttaaatatcctgggcactgatagaaatgtattttcaggtgcatacatatttcagaacacaccaatgtgtatactcaaatatatgcaatttattgcatgtcaaaatcctgtgcacatttctgtggctatactaggcacatagttttatcataatttacatggggttgggtgcggtggttcacgcctgtaataccagcactttgggaggctgaggtgggtggttcacttgaggtcaggagtttgagaccagcctggccaacatggtgaaaccctgtctctactaaaaatagaaaaattagccaggcgtggtggcgcatgcctgtaaaatcgcagttgctcgggaggctgaggcacaagaatcatttgaacccaggaggcagaggttgcagtgagctgagatcacgccactgcactccagcctgggtgatagagcaagagtctgtctcaaataataattataattattattttatgcgtaatttccattccagcccccactcccccactccctccaccagactgtgaggcccctttagggaaggcaggcatcttggagacgttttatgtggctccctaggtcctttagtaggtgctcaataaatatttgcatagggatatccatgagccttgatgttaacccagggaatataacaggtgagtggattgtgttttgtttgggtttagcttcagatttttggcagtatttaatcatttaacccagcataaagtttatttatttatttatttattttgacacagagtctcggtctgtcactcaagctggagtgcagtggcgccatctcggctcactgcaagctccacctcctgagttcacaccattctcctgcctcagcctcctgagtagctgggactacaggcacccgccaccacacccagctaatttttcgtattttagtagagacggggtttcaccatgttagctagggtggtctcgatctcctgacctcgtgatccgcccgcctcagcctcccaaagtgctgggattataggcgtgagccaccgcgcctggccaagtttttttttttttttctgttaaaggggatcagctgtttaaccagatgtgggtaatcattttgaaaccttctctcctagacaccatgccacaaggagagtgatctcttcccctgttttcacaatggaggactccggaaagactttcagctccgaggaggaagaagctaactattggaaagatctggcgatgacctacaaacagaggtcagtccgagttcacctgcttttccttttttttttttttttgagatggggtcctgctatgttacctaggctgagtgcggtggctgttcctaggcgtgatcatagtgcacagccgccttaaactcctgggcttaagcgatcatcctggctcagcctcccaagtagatgggactataggtgtgcttcatcaggccaggcttttttttttttggcggaaacaggggtctcgctatgttgcccaggctggtcttgaactcctggactcaagtgatgcacctctgcctcccacagtgttgggactacaggtgtgagctctcttttttctataaaaagaacagcaaccatttattgcaggcctatatgtgccaggcagtgtgaaaggcttaacttacactatctcaaaactgcctgtgaaaaaactattagcaccccattatatagatgaagaaactgagcctcagtgaaggcagataacttgctcacagtcacacagccaataagtagcagagctggaatttgaactccagacctatggtcctgattatcctactatgctactttacattttgttttcttattttctttttcttcttttttttttgagacagagtctcactctgttgcccaggctggagtgcagtggtgccatcttggctcactgcagcctccacctctgggttgaagcaattctcgtgcctcagcttctcgagtagctggaattacaggcacccaccaccacgcctggctaattttttgtgtttttagcagagacggggttttgccatgctggtcaggctggtcttgaactcctggcttcacgtgatctgcccgtctcaccctcccaaagttctggaattacaggcatgagccaccatgcctggccttccatcttattttcttttttttttttttgagatggagtttcgctcttcttgcccaggctgtagtgcaatggcatgatctcggctcaccacaagctccacctcctgggttcaatcgattctcttgcctcagcctcccgagtagctaggattacaggcatgcaccaccatgcccagctaattttgtatttttagtagagacggggtttctccatgttggtcaggcagctctcgaactcccaacctcaggtgatccacttgcctcggcttccctaagtgctgggattacaggcgtgagccaccacgcccggtgtccatcttattttctagaagggtttttatcagttcctagatgccatatctggtaagttctttgtgcacagggaaagagcttttccctatgcctagcaaaatatattgctaaagattttaagatttgaaactcgtgttttggtcagggctcatatctgggaggtgtgtgtgtgtgcgtttggtttggcactgtttttatttataatgggtctttataatttgtacatagaggccttattccagtccccttagtttctttcatttattgaaaaattattttaggtccaggcacagtggctcacatctgtaatcccagcactttgggtaggcagatcacttgagctcaggagtttgagaccagctctagcaacatggcaaaaccctgtctgtacaaaaaatacagaaattagcaggcatggtggcatgttcttatagtctcagctacttgggagcctgaggtgggagaattgcttgagcctgggaggtcgaggctgcagtgacgcatgatcacacctctgcattccagtctgggtgacagagcaagactctatctcaaataaataaataaaaattattttagagtcagggtctcactctgtcacccaggctgaattgcactggctcttcacaagtgtgacctatctcactgcaacccctgggaccccaggtgatccttctgcctcagcctcccaggtagctgggactacaggcgtgtgccaccatgtctggctgatttttaaacacatttctgtagagatgaggtcttactatgttgccctggctggtctggaactcctggcctcaagtaattcttaatgagccactgtacccagcccttcctactttctttattctagtttgacttaaaggtaattcaggcttgatatttttaaaatattccttgaatttggccaggtacaatggctaacgcctgtaatcccagcactttgagaggccgaggcaggcagatcacctccagtcaggagatcgagaccagcctggccaacatggtgaaaccccgtcactactaaaaatacaaaaattagctgggtgtggtgccgcatgcctgtagtcccagctactcgggagactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggtgaggggctgagaggaagtgtgctcaggtgtagacaggcgtccaacacaggcatggcatgcttggctggaagaaggaaccctgcaatgagggactccagaccccaggcccatgctcatctctggaagggcctgtgcggcagacgtgatctttgaactctttgtgcctctagtgggtggtgctttttgttttgttttttttttttttttgagatggagtttcactcttgttgcccaggctggagggcagtggcgcgatcttggctcactgcaacctccacctcccaggttcaagtaattctcctgcctcagcctcctgagtagctgggattataggcgcctgctaccacgcctggctaattttttttgtatttgtagtagagacggggttttatgttggccaggctggtctcgaactcctgacctcgggatccatgatgggtggagctttgagaagcaagtcacacacatgttcccgtggactttcttggttgtgtacactgattttatagggcacatggcagggagacttttttttttttttgaaacagggtcttgctctgttgcccagactggagtacagtggctggattacagctcactgcaccctggacgtctcaggtttaagcagtcctctcacctgggccgggcgaggtggtgcatacctgtaatcccagcactttgggaggctgaggtgggcagatcacgaggtcaagagattgagaccatcctggccaacatgatgaaaccctgtctctactaaaattacaaatattagctgggcgtggtggtacacgcctatagtcccagcttacttgggaggctgaggcaggagaatcacttgatggttggaggctgtagtgagctgagattgtgccactgcactccagcctggcaacagagcgagactccgtctcaaaaaaaaccaaagtccttccacctgaacctcgggagtagctgagactacaggcatgcggcaccatgcctggttagtttttgtattttttatagagacagggtttcgctgtgttgcccaggctggtcttgaactcctggacgcgagcagtcctcctgccttggcctcccaaattgctgggattataggcatgagccaccacctggccagggagacatttttagggtatggaggtgttgctagagtaatatcatcaggtccaatattgtagcccttagctacatttggctgttgaaatttaatgaattaaaataaaaacttaattcctcagtcacagtagccacatttcaagtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactgaggtttgctttgtgggttttttgtttgtttgttttgtatttttgagatggagtcttgctctgttgcccaggctggagtgcagtagcgcgatctcggctcactgcaagctccgcctcccaggttcacaccattctcctgcctcagcctcccgagtagctaggactacaggcgcctgccaccacgcctggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatctcacctcactgcaacctccgcctcccaggttcaagtgattgtcccgcctcagcctcttgagtagctgggattacaggcaccctccaccacgcctggctaattttttttttttttttttttgagacgcagtctcactctgttgccaggctggagtgcagtggcgtaatcccggctcactgcaacctccacctcctgggttcaagtgattctcctgcctcagcctcctgagtagctgagattacaggcacacaccgccatgcctggctaatttttgtatttttagtagagatggggtttcaccatgttttccaggatggtcttgatctcttgacagtgtgatctacccgccttagcctcccaaagtgctgggattacaggtgtgagccaccacgcccggctaatttttgtatttttagcaaggacgaggtttcaccatgttggccaggctggtctcgaactcctgagctcaggtgatccgcccgcctcagcctcccaaagtgctgggattacaagcatgagtcaccccgcctgaccacactgtgggatgtttggcagcatccctggcctccaccctctagatgccagtagcattccccgcacctccaaggtggtgaaaaccaaaagcacctctagacatagccaggtatctggagacccagtgctctgcaaggtaaaaaccatcccttctgtacatgctgtagggctcagcaagggatcactaagtcaacaccgtgccccagagactggctctcagccttagctgccagccagcatcactaggccagcttcataaacatccgacaggcctgaaccctctctccccatccccatctccccgccttgctctgagattccatttctcagtaagtctgggtggggccctggcatgtctgtgtggttttctttttctcattaaactcccaatgtacattttgatgagctgcttcatggaagagtcaaaactgtgtgtgcccagggctaggtatgatggacggtgaaaggggaagtgctggttgccttctttgggaagacaaacctaatgccatgaagcagttggggacgtgaagctcagtcacagaactctgatgtgggggcctttcaagagaaaaaggactggctgggtgcggtggctcatgcctgttatcccagcacttcaggaggccgaggtgggcagatcacctgaggttgggagtttgagaccagcctcaccaacatgacaaaaccctgtctctactaaaactacaaaattagctgggtgttgttgtatgtgcctgtaatcccagctacttgggaggctgaggcaggagaatcacttgaacccgggaggcggaggttgcagtgagccgagattgcaccattgcactctagcttgggcaacaagagcgaaactctgtctcaaaaaaaaaaaaaaagaaagaaaaagaaaggactgcatgggttgagggaggctgtgtggagggtgtttgtaggtgtatgtgttgctgacacttggtgcttggggagatggggctgaaggagagttgatctgtacccatcacagacgtggacaagaatgggtgtcgggtggaccttggcaagcccagctttactaatgtataggaaagggtgtgggaccaacaaatggattgggggtttggggcagggcggaggagaggtcccagacacgttgaaggtggtcattgaagctgaagctttctgttggagaccacagagtgcagctggccgtctgcagatccatctgccccataggtgttgtttgatcgccttcaggggtttttgttcagcatttccccatgaacgttttccagcatataaggctgaaagaatttccagtgaatacctgtgtatccaccaccacctaggctctaccaataatatttcccctacttacttgccttttattatatatattcccccatccatcaaaatttgtaaagcttcctgtaaaaagatggatttctggccaggcatggtggttcatacttgtaatcccagccctttgagaggctgaggagggagaattgcttgagaccaggagttcaaggccagcctgggcaacatagcgagactctgtctctacaaaaaaataaaaataaaaaattcattggacatggtagtgcacacctgtagtctaagctactcaagaggctgaggcaggagcattgcttgagcccaggaggttgaggctgcagtgagctatgattgtaccattgcactccatcctgggtgacagagcaaaagttaaaaaataaaaaacctgagtagtggttgtttagaacacacattgttgagtttcccccaatccccatatccgtgacacggagaccttagtgtcatctgcctctccctgtacttggcccacttcacccatttgttaacagctgaacacctgctacacacaatgagcaatgattatcgttctttttgttgttgttgtttttgctgttggagacagagtctccccctgtcacccaggctggagtgcagtggtgtgatctcagctcactgcaacctctgacttccaggcttaagtgatcctcccacctcagcctcccaagtagctgagattacaggcacctgccacaccacgcctggctaatttttgttattttttgtagagacgggttcatgtgcccatgctagtctgggactcctgagctcaagtgatccgcctgcctcggcctctcaaagtgctgggattacaggtgtgagccactgcgcctggctgattatagttcctaaattgaaggggactctgggttgaaaagctgggtaggaggaagattagtggtatgaactgcagtttggagaggataacaggccctccatggatcctgagtaaaatatcaagagaattactcagtaattctctgcttcaagactgagctcttgggcctggcgtggtggctgatgcctgtaatgccagcactttgggagaccgaggcgggcggatcatgaggtcaagagattgagactgtcctcgctaacatggtgaaaccccgtctctactaaaaataaaaaaattagctgggcatggtggcgcacacctgtagtcccagctactcgggggctgaggcaggagaattgcttgaacctaggaggtggaggttgcagtgagctgagattgcgccactgtactgcagccacatgtcagatgcaggagactcagagcacacagcacagtgaagaaacagggtaccttggaataacgaggaccctgccaccagcaagtatttgtcagtcacctaagagaaatatattcagctgggccggacttcttaacaactggcttattcatcacgggttgaatgaaaaagcctttaagggaccaaacagagcatctattgatgcccccatcagctgacagcttattcgaattagccccaaatggcagcacaacatttcagcaacaggttttcatgtccacaggttccgaggagatctctcaatcgccagtgcagtcggtggagcccactcgctgcgtcctcctggagcctgcgtttgaatttaggttaatgacttaagatcctgttttatttggagatgttcccaaataaagggtgtgaggcgatgagagccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgcaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcgattctcctgcctcagcctcccgagtggctgggattatagacaacgcaccaccacactcggctaatttttttttgcatttttggtagagacggggtttcaccatgttgtccaggctggtcttgaactcctgacctcaggtgatccacctgcctcagcctcccaaattgctgggattacaggtgtgggtcactgctcccggcctgtctttgtttttaaacccagagattggaatgttctttctgtctccatgctacaacggagagtcctggatcaaaaattcagaataattgactgttgtgtaaaccaagtacatgctgctctcccattgttgtgggcacaaacaacagaagtcattgagattcctttttttttgctttttgagatagctgggtctcactctgttgcccaggttggagtgcagtgatgcaatcacggctcactgcagcttcaacctcccaggctcaaatggtgttcccatctcagcctcctaactgggactacaggcgacgccaccatgccctgctaatttttattttttgtagagactgagtctggctctgtgggccacgctggtgactctttgtaatacggtgataatgtgtgaaagcaggcttgcgttgcccctgtggatgaggcttggagaggtccatgtggctttctttggttgtggacaccttgggcagaatgatttgtctgaagattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggtttttttttttttttgcttgttttttttaagtgtcgtggtctcactctgtggcctgggcgggagtgcagcggcgtgatcatagctcactgcagcctcaacctcctggtctcaggcagtcttcttgcctcaccctcccaagtagctaggactacaggtgcatgccaccacgcctggctgttttcacattttttgtagaggcagagtcttgcccaggctggtcgagaactcctgggctcaagcaatcctgcctctgccacctgaaagtgctgggattacaggcatgaggcaccacacctggctctgggtgtttggtgaaggaaagtaatttggaagcagagccggaacagaatcaagagagctcgggagtgggcaggtgatctggattgaaatggtttggggctggttagcataattgcttaaggacacctgctcaggaggctggggtttgatcttggctcagtcatttgctaccagttgattctgggctagtcaggtcactgagcttcagtgttcatgtctccaaagtgggattaatgagacaacataggtggtgtacttagcctggaggtggcacagaataagtatgtaatggatgttattgctgcagctggcaacagggaatcattgagaagtcagctggactgttcctttggtaattaacatagatctctctccctttccttccctctccctcccttcctctctcctctgtctcccttcctctctcctctctctccctcccccattttatcccctccttttctccctccttctttttctttctttctttgtttttctggtttttttttttttttttgagacagagtctcgctgttattgcccaggctggagtgcagtggtgcaacctccgcctcccgtgttcaagcgattctcccgcgtcagccttctgagtagctgggattataggcatgcaccaccacgcctggctaatttttttgtatttttagtagagtccagatttcaccatgttttcgaggcaggtctcaaacttctgacctcaggtgatccgcccacctcagccctccaaagtgctgggattacaggtgtgagccactgcgcctggcctgtctttatgtttttaaataacctagagatcaaactgttccttttttctccatgtcacaacggggagtcctggatcaaaaattcagaatggcggactgttttaaaaccaagttcatgctgccctcccattgttgtgggcacaaacaacggacgtcattatgatttctttccttttgaggcagcagggagttgcccaggccggagtgcagtggtgccttcacagcccactgcagcttcgacctctcaggctcgaatggtcctcccacctcagcctcgcgagtagctaggactacaggcaagagccaccatgccctgctagtttttattttttgtagaggccaggtctcactctgtgagccgggctggtgactctctttgtaatacactgatgatatgtgtgaaggaggcccatgttgccgtgtggatgaggcttggagaggtttacgtggcttgctttggctgtggacaccttgggtagaatgatttgtctgaagaatgatggaggctataggaatctcaaccctgttgagagtaggcaagattcaaggtgctcagggggcagaggcactcaggacataattaaaacagttggtccgttgtgcctgctttgaatgacacctgcctgttcccaccacgttacatcacttgcctaagagtcagctctggagagaaggttctgttgactgagcctggcttgtctcccgattgtggtgggagggtgggacagaaagcctggagccccacccagggagtgtggtgggaggagtagtttcataaagagagagggtcaggccaggtgcagtggctcacacctgtaatcccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaagaacagttttttgtttttttttggagacggagagtctctgtcgccaggttggtgtacagtggcgtgatttcggctcactacaatccctgcctcctggattcaagcaattctcatgcctcaggctcctgagtagctggaattacaggcacgtgccaccacaccattctaatttttgtatctttagtagggatgggctcttgccatgttggccaggctggtctcaaactccttagcctccaaagtgctgtgattacaggtgtgagccactgcgcccagcccagtgattcctaaactgatgttctgtggtttagcagaatgataatgactaacatttacagaagaattactctcagccaagcagtttttttggataagaacacttgtttttaaaaaatttatatatgaattatatacagtgaaatgcgcagatgtggccaggcacggtggctcacgcctgtaatcccagcacttttggaggccgaggtgggcggatcacgaggtcaggagatcgagaccatcctggctaacatggtgaaaacccgtctctactaaaaatacaaaaaattagccgggcgtggtggcgggtgcctgtagtcccagctagtcgggaggctgaggcaggagaatgatgtgaactgggaagggcggagcgtgtagtgagccgagattgcgccactgcactccagcctgggtgacagagctagactctgtctcaaaaacaaaacaaaacaaaaaacaacaaaaaaacaaaaaaagcacagatgttttttcttttatttatttttggaaacagggtcttgctctgttacccaggctggagggcagtggtgccaccatagtgcattgcagcctgaaacttctgggagcaagtgatcctcctgcctcaacctcccaaagttctggaattactggcatgagccactgcacccggcctcctcagagagttttttttctgcctcattctttttctcctgtccgtctcggacgccatctatacacataacctttttatattgtcaggcaggttcctaaggctctcttcatttttcttttccctaattatttttttgtctttgttcttcaaattgaataatttctgtttatccagtttcaagttgatagacgccctcttctctctccaatctgccattatagcagatgaaatattgaattttcaatatattgtatttttagatgtaggatttgtgtttgttcttttataatttctgttctattgaggtttcttgacatccttgagcatagttgtaagagctgctttgaggtccttttgtgcagttttcaacatctgggtcacattttctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtgattctcctgcctcaacctccggagtagctgggattacaggtgtgtgttaccacacccggctaatttttgtatttttagtagagatgggatttcaccatgttggccaatctggtctcatactcctgacctgaggtgatctgcctgcctcggtctccgaaagtgctgggattacgggcttgagccaccatacccagccagagatgatgaattcttttatgttcttgatttatttggttttcttaggtggtttacttggctgagcttacagcccaaattctgtctcccctttgatgggcagtagctgaaatctctttgctttttttagccgtaactgggctgctttgtgtctgctctgtgcacgtgtggtttgggggaggccagagatgtgggaagatactatattcagaatgtgggggggcccacggtgatagatttctatccctggagctttaggcaaaaatcttgtaaagatgcagacttcacccagtcttgttctgtttttctaagcgttgttttccagttcctgccagtgcactcagattattgttgtaaacattttacttagaatttatacgaggtttgatctgatacaggtttcctggtcattaccagaagtggaaattcctttcttgtcaatctgtaggagttctttgcatatatatattttttgagatggagtctcgctctgtctcccaggctggagctggagttcagtggtgtgatctcaggtcactgcaaccactgccttcctgcttcaagtgattctcctgcctcagcctcccaagtagctgggattacaggcgccccccaccacgcctggctaatttttgtatttttagcagagacggagttttgcgatgttggagaggctggtcttgaactcctgacctcaagtgatccacctgcctcagattcccaaagctggaattacaggcatgaaccactgtgcctggccctttgtatatttttactactaatcttttctcctgcattgaaaataattttttccgtggtaatcttttgtttgttgactttgtctattgtatcattttccatacaaatatttccttttttctcttttgaaaaaaaattttttatacatgtatttttcatttttaggtcatcagttacatctttttttaaataccttctaggtttgcagatttcactagggaagtctccttggttcttgattgttcatgtgttttgtgttttttttgcaatattttttaattgtttaatttttttgtatccttattccttagtctgcaatgaatttatttttgtatctagtataagatacaagttcaattttatttttattttctttaggtggatagcccagttgtgccagcactgttaaacactgccttttttttttttttttttttttttttttttgagactgggcctcgctccattgcccagagtagagtgccatggtgcaattacagctcactggagccttgacctcctggggcaagtgattctcccacctcagcctcctgagtgtctgggactataggcatgtgccactatacctggctaatttttgtattttttgtagatacagggtttttccatgttgcctaggctggtctcaaagtcctggactcggtctgtccaccttggcctcccaaagtgctgggattataggcatgagccaccatacccggcctttggcatattttaaaattgggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtcgcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctatacgtccctcaaacgaaactactcacttttaactgaggacaggcactttgtataagaataaccttgaaaagtgtgcaggacctaattggaagtaactaaaaattaaatacatttcctaaaggttactttgtttcatatgagtactaagatgccaaaaagttttacaaaaattcaaatagatttaatctagttttactcttttcataagtttttcattttattttatttatttatttttgagacagagtcttgctctgtagcccaggctggagtgcagtggtgcgatcttagctcactgcagcctctgcctcccaggttcaaatgattttcctgcctcagcctctcgagtagctgggactacattgcatgtgccattatgcccagctaatttttctatttttagtagaaatggggtctcaccatggtcctgacctcaagcgatccaccacctcggcctcccaaagtgctgggattatagccgttagctctcacacccagtccaacttacacattttttttttttaaagagatggggtcacacagtgtttcccaggctggtctcaaactcctggattcaaacaatcttcccatctcggcttgccaaagtgttgggattacaagcatgagccactgtgcccagccaattccatggacttttaaagcattttttggctcaaaaaggatatgttcttagttatctaaccagtatatctctttatatttactgaaaatctgttttcctatttaagtattttcaggttctcaataactgcacatgaaattaacagctttcatagtcacaaattattgcaatattttgctgttatactaaatatgggttttttttgtttgtttttaagacagagtctagctctgttacccaggctggagtgcattggcacaatcttggctcactgcaagctccgcctcccaggttcatgccattctcctggcctcagcctcccgagtacctgggacaacaggcacccgctaccacgaaccggctaatttttttgtatttttagtagagatggggtttcgccatgttagccaagatggtctcgatctcctgactttgtgatccacccgcctcagcctcccaaagtgctgggattacaggcactaaatatgcttttatacattagttgacagaatttcaacatataaaatacataaagcaattttcactccagttacaactagcatgctgacctttatttcaaagtaaatacgctaggtgagatagctcatgcctgtaatctgtcatcttagtacttggggaggctgaggcttgagtattgcttgagcccaggagtttgaggacatcctgggcaacatagtgagactcccgtctctagaaacaaatataaaaactagccggctatggtagcttgtgcctgtggtcacaactactcgggaggttgaggtaagaaggtgaaagaatcgctgggcgcattggctcacgcctgtaatcccagcactttgggaggctgaggtgggcggatcacctgaggttaggagttggagaccagcctgacaaagatggtgaaaccctgtctctactaaaaatgcaaaaattagccaggcatggtggcaggcgcctgtaatcccagttacttgacagactgaggcaggagaatcgcttgtacccgagaggcggaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcagaaatgccactgaagggccaggcatggtgtccaacacctacaatcccagcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaaaaaaaaaaaaaaaaaggcactgaagctggtccccagttccctagcattccagaagcaaaatagattttgaccaaataaggagtttgttaaaatttccgattcagtcggagtttgtgttagggtacagtatgaggtacgaatctaataattttttcctggtgggtacccagtggtccctaaaactagaactgaacctgccatctttttaccaatgatctgtgatgccacctttattataaattaaactcttgtctatttctggacctttggttcctttgttcttacaaccagtagcatactattcttcattgttgaggctttatagtagtgcgttctgactctctggtagagctagttccctgatctcttttacagagttcctctgatcattcttgtttcattgtcacaggatctttcaaatcagtccagtttattcccccagtagaaacgtattaagacagtgttaaatttatcagtttaacttgtggagaattaatttctgcatgataatgggtcttcctctttatatactcagtatgtctgcatttctgcaagcattctgtactactctacatattattatgtgaatattttatctttgatatgtcaaccttagggctgttttaactgtttctggtattgtactccgaagtattatccctttgttgttggtagtagtgtgttttttgtttttgtttttcgagacagggtctggcattgttacccaggctggagtgcagtggcatagtcatggcttactgtacccttgaattcctgggctcaagcagtcctcctacctcagcctccgagtagctgggactacaggcacgcatcatgcacggctaatttttttactttttgtagagacagggtctctctatattacccaggctggtcttgaaccctgggcctcaagcggtcctcacaccttggcctcccaaagtgctgggattataggcatgaaccactgtgcttgtccctttgttgtttttaatcggtactgtggtaactttatcctatccactacttctaaagaccctgtgagggtaggtacttgtatgactccatctagacatagtaggatatgttgaataaatgaactgatgcagccattaatcagtgcagttattaatttggtgattgaaggaactgaggatgaaggagatcaagttccgcaatgatactcagtgagttctaggtggaggaggagctgggtgttaactcctgggttcctctccaaacacgtgcttctgaccactgtgggatacagttagcaggttgtgtaaggtctggggacagacacagggtcaataataaaaattgctgaaaatttatagatgtgtgcttatgtgtaaaacatctgttgtgtgcttcctgtaggattttttttttttttttgggaaacattcttactctgttgcccaagctggagtgcagtggcatgatcttggctcactgcaacattcaccttctgggttcaagcgattctcctgtctcaccctcccgagcagctgggactacatgtgtgcaccatcatgcccggctaatttttgtatttttagtagagatgaggtttcaccatgtcggccaggctggtctcgaactcctgacctcaagtgatccgcccgcctcggcctcccaaagtgctgggattacaggcgtgagccaccgtgtccgggcctgtatgacttcttgccaccccttccccaccacaatcctgcatgaaggttactattactatccttgttttgcatgagagaaaactgaggtgcagagaaggtggttttcccagaattataacagattgttttcttacagcacttggcagtgcctttaccacagtgtttatgcccttcacaagaaggggttgtgagcagggcagctgggctggtactgggcattttgaacttccactgagaggttaaatatgatctcttccacctgcttaagtgcatcttatgcctggcacaatgcctcatgcctgtaatctcagtaactcaggaggctgaggcgggaggatctcttgagcccaagagtttgagattgcagtgagctgtgattgtaccactgcacttcggcctgagagacacagcaaaaacctgtgtcttaaaaaatcatgttgttatatgtgtttattaggttattattattttgagatggagtctcactttgttgtctaggctggagtgcagtggtataatctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcaggtaaagagcccatgccccagaaggttaagggacttggcccactctgtggcatctaggaagtttggggctgggacttgtgcccaggtgtgtctgacccttcgcacctcctggatccgcggtgctggagggatgctgcggtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaatttatttccagaaagatgcttcctggtctgtaattcacaaacacagcaaactaccctgatgctcagtaggaacagagagttttgtggggagatctggcacagtggctcacacctgtaatcccagcactttgggaggccgaggatctcttgagcccaggagtttgagaccagcctgggcagcatagtgggactccatctttacaaaaacatttaaagattagctgggtgtgatggcatgtgcctgtagtcccagctactcaggaagccaaggtgggatgattgcttcagcccaggaggtggagtatgcagtgagctatgatggcaccagtgcactccagcctgggtgacagagtgagaccctgtctcttaagaagcaaagatgttgtggggagaaatttctggtggaattgccagctagcctattatttttgtgacttgatggcaaccaatatatttggctaaaactttgaaacctcatcagcatttgctctttttcagttggcacttccagaggtagaatgttgaaactgtaatgaggcatttggccaggcacagtggttcacacctgtaatcccagcactttgggaggctgaggcaggtggatcacctgagctcaggagtttgagaccagcctggacaacatagagaaaccccatctctactaaaaatagaaaacatgagggtatggtggtgggtgcctgcaatcccagctgctcaggaggctgaggcacgagaattgcttgaacctgggaggtggaggttgtagtgagccaaaattacaccattgcactccagcctgggtgacagagtgagactcttgtctcaaaaaaaaaaaaaaaaaaaagacattcattagtggattgtccaagttgtttttacctttttttttttttttttttttttttttgagatggcgtcttgctctgttgtccaggctggagtgcagtggtgctatctctgctcactgcaacctctgcctcccaggttcagcgattcccctgcttcagcctcctgagtagctgggactgcaggtgtgcaccaccatgcctggctaatttttatatttttaatagagatggggtttcaccatgttggccaggctggtcttgaactcctgaccccaggcgatctgcctgcctcggcctcccaaagtgctgggattataggggtgggtcactgttgctggcccaattaattatttataacgtcgatttgctttctaatgtgtaaccagtaggtgggggataaaaagtaaaaattcttaagtttaataaagtagttgttcctagatgtccatcagtaatgaagtggttaaatgaagtacatagatgtattttgtgaaatgttaatggttaaaatgaacagtagatagaaatgttgtggtagaaagattgccaaggctaggcacagtggctgatgcctgtaatctcagtgctttgagagacggacgcaagaggattgcttgagcctaggagttcaagatgagcctggacaacatagtgataccccatctctacaaaaatgaaaattgtaaaaattaggcctggtggcatatgtctgtagttccagctacttaggaggctgaagtgggaggatgacttgagcccaggagttcaaggttacattgagctatgattgtgccaccgcaccccagcctgggtgactgagtcagaccctgtctctaaaacaaaaatcattgccaagacataccactgaagtggggagagtaagtcatacacaggacaacatattgtatgtttccagtaatgcttaataaaaaattttcttgttttatgctcagtagatacatacatatgtataaagtttatgtttgaaaatggagagaacagctgggcgcagtggctcacgcctgtattcccagcactttgggaggccaaggtgggtggatcacctgaggtcaggagttagagtccagcctggacaacatggtgaaaccctgtgtctactaaaaatacaaaaattagccaggtgtggtggtgcgtgcctgtaatcccagctacttgggaggctgaggcaggagaatcacttgaacccgggaggcagatttacagtgagccgagactgtgccactgcacttaagcccgggcaagagagtgaaactccatctcaaaaaaaaaaaaaaaaaaaaattcagagaacaatggttgaaaagctctcccacatgttatggtgatgatgagtgaggaggagcatttggggatagtctggaaagcatactttatttatttttgagacagtcttgctctgtcacacaggctggagtgcagtggcgtgatctcagctcactgcactcactgcttgtcccccaggctcaagcgattgtcttgcctcagcctcccaagcagctgggactacaggcgctcaccaccacgcatggctaattttttgtatttttaatagagacggggttttgccatgttggcctgaaaattcctgacctcaagcaatcctcccatctcgacctctcagagtgctgggattataggcttgagccagtgcaactggcctttttttttttttttcttttttttttttttttttttttttttttgagccagaggtctcactctcgcccaggctgaagtggtatgatcatggcttactgcagcctcgacttactggattaatgtgattcttacacctcagcctcccaaagtgctgggattacaggcatgagtcactgctcccgggcatattttcatttagtgttctaaatacactgctatgttggaattgttttttcaataataaaagcattagtgtgtcactgtcatagctttttaaaaatctgaaaccattttgttagtcaagagaaacatcctgtagagttccaagtctgctaggcaaggtcctgtgggtttccctttatttggggtttctacctggagtgtttcaccccagtaggtcttttttctgactggtatctactgttgaacctctctccctgcaccccaccaaccctaagcaaggacttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcgatccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcacctggctaacttttgtattttaggtggagacacagtcttgccatgtcgcccaggctggtatcaaattcctggactcaagtgatccgcccacctcggctgatcccaaagtgctgggattacaggtgtgagccaccgcgcctggtcaaaaatcctcttgttgaatataaaacctcccaaatttgaaatgtcactgaccaaatacaaaaaagtaaaaagcgttctgtgggtttagtaatacatccaccgagagctagactcagcgtaacgtgtgctgcatgggcagaaaaaaagaatctcagttctcaccccagcccctctgctgacagcttccgatcaggccttttacagcagatattaataacagacagttaaggagtgctcagtgtgtgctggccagcctgcagccttcgccgcaggcccaggatgcaggtgctgtccccgtttgatgaaagtgaggctctgagttaagcagagtcatgaagcaattgaatggcagatggtttgggattcagacccaggcaggcaggctccagggcttaccctaccatctactaccttatcccttagcttgtcccctgggcatgaagagaccagtgagacttctagaattccggtgcagagcccttctgtttagttttgttgagatggagttttgctctgttgcccaggctggagtgcaatggtgcgatattggctcgctgtaaccccctcctcccaggttcaagtgattctcctgcctcagcctcctgagtaagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaactcctgggctccagtgatcctcctgcctcagcctcctgagtagctgggactagaggcatgcaactccatgcctggctatgtttccacacttcaatatgcatgtagcttacctggggatcttggtagaatgtacctcagatcaagtgggtcttgggtggggcctgaaatttctttctctctttttttttttttttgagacaaagtcttgctctgtcggccaggctggagtgcagcggcattgatcttggctcactgcagcctctgcctcctggattcaagcgattctcatgcctcagcctcccgagtagctgggattacaggcaggcacctgttaccatgcccagctaattttgtatttttagtagaaacaagattttgccatgttggccaggctggtcttgaactcctgacctcaactgatcgaactgcctcggcctctgaaagcactgggattacaggtgtgagctactgtgcctggccgagagattctgcatttctaacagttctcatgtgctgctggtgcatggaccccacttggagaagagaggctctgcagagcgggacccttgtaaagctggatcatcctgtctatagttcttgtatctatcacagatgccattatgttaattaactatatggattttctacaatttcaaaaggatttgttttgggtttgtttaaaaagactaatgtggctgggcacggtggctcatgcctgtaaataccagccctttgggcggccaaggtgggaggatcgcttgaaactaggagttcatgatcagcctgggcaacatagtgagaccctgtctctattaaaaaaaaaatttgttaaaggccaggcatggtggctcacgcccgtaatcccagcacttttggaggccaaggcgggcagatcatttgaggtcaagagttcgagaccagcctggacaacgtgatggaactctgtctctactaaaaatacaaaaattagccgggtgtggtggcacatggctataatcccagctactcaagaggccaaggcaggagaatcgcttgaacctgggaggcggaggttgcagtgagctgagatcacatcaccgcactccagtccgggtgacagagcaagactaacatgtaaaaataagtatttgttgcagtcatcacaaggacttgaaaaattggttgtcatacgggccttgggtgtgtgatgcggttaactacggaaagaaatagggtagcttttgggatccgaggaaaggcgtcagtgtccctcctgtcccgtggttttggatctagcgatgttaacgcacagacatgactataggttggtgagttacatgctcttccctttgcacacccaggcctggacgactccaccggggggacccccctcacacctgcggcccggatatcagccctcaacattgtgggagacctactgcggaaagtcggggtaagaccacactttcctggcgtttggtgccttcctgcctgtctttcaggatgtgtgaagggggttgatctagttccttccctctcttctttttttctttttttttagagacagggtcttgctctgttgctcaggctggagtgtagtggtatgatcacaactcactgcagcctcaaaatcctgggttcaagcgatcctctcaccttagcttcccgaggagcttggaccacaggtgtgcgccactatgcctggctgatactttcatttttttgtagtaatgtgggtatcgctgtgttgcccaggctggtcttaaactcctggcctcaagtgatcctcccaggttggcctcccaaagttctgggattacaggcatgagccaatgcgtccagcccctttcatagcagtgtggtgagttttaggtgtggctgctcctttagcatccctgggaatcattagagcttcctgtgggagttactgccagacactcagagctctgactcgaagccctgctctgaaccctatgtatgtctctttccttttaccgtttttcctctaggaaatttgggaaattagggtgatatgtgtgttttttccttaactcgaaaaattaaggagcacttggaaactgccttctcttttggccgggtgctcatacctgtaatcccagtgctttgggaggccaaggtgggagattacttgagctcaggagtctgacaccagcccgggcaacatggtgaaaccccctgccccgacttggcctctacaagaatgcaaaaattagccaggcctgatggtgtacactggtggtcccagctactcaggaggctgagaggtgggaggattgcttcagcctgggaggttgaggctgagtgagctgagattccaacactgcactccatcctgggtgacagcacgacgttgtctcagaagagaaaaaaactgccaccttttttttttttttttttttttttggtttgtttcttggggtttaagtgaattttgacactttgggagaccgagatgggtggatcacctgaagtcaggaattcaagaccagcctggccaacatggtgaaaccccatctctactaaaaatacaaaaattagccaggaatggtggtgggcacctgcgatcccagctacttgagaggcttatgcaggaaaattgtttgaatccgggaggcggaggttgcagtgagctgagatcgcaccgctgggtgacaaagtgagacttggtctcaaaaaaaaaaaaaaaaaaaatcttgaaagcctagggcaaagaatttggcctttcagcttttatgttaattacagggagggatccttttgtgcttaagtaaaaacataggtattctttgtagtttatttttaaaaatgatgcctagaaggccacataatttaactcctaccaagttgtcactgtacacagtgtatttgtagctacaacttaatagaagcttgcaactcatttcttttgtttttacttctggtttttggctgtctggtttgctattctagaagcaggtctgcatttcagtatttagcctagttggagtatagagaagcctggggtgctgtcagtgtccttttggtttcctcagggtctgttgtagccagaccaagtccttaccaaacttcttgccattctgcagaggtttaacaaggtaaaccaaagggtgaaggattccagaagtggatttcctacttcctacaagcggagttggataattggtaggttagtgatttttccagaaagctcccattttaaaaaattttttgtaattaaaaaagaattttttttttttttttaagccaagcatgattgtgcatagtcctagctattcaggaggctgaggtggaaggattggttgaggctgcagtgagccgtgatctttttccaggcagctcccaaacattttaaaaaatttttcgtaattaaaaaaaattttttgcattaaaaattttttttattaactgggcatgattgcggatgcctataattccagctgctcaggaggctgaggtgggagggattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctgggattataggtgtgagccattgtgcccagccagctcccaaatacttaaggtgcttggttctgagactggcatatacgttggattcctcttggggtcccaccttggaattccagtgcacaacagtttgagaaccactgtctggggttcgttcttctgtacaggctctggtaagacagaatagtccttgcctataacttgagagataaaagtgtatttctgtccaggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcacccccagcccacagccatgtgtctttttaaattataggattatttcagcaaaccttatcctctcctctgctccctgcaggcagcattaggtggtgtcttgtggcttgaacaaagggctagagagagggtcttgttttgtgagacagggtctcactctgtcacctaggctagaatacgatggcaggatcatggctcaccctctgcctcccagctcaaacgatcctcccacctcagtcccccgagtagctgggagtacaggtgcgtgtcaccgtgctcggctaattttttgtattttttctagagacaggttttgccatgttgccgagtttggtctcaaactctgagcttcaagtgatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggcatggtagcatgtgcctatagtcccagctactcaggaggctgaggaaggagaatcacttgaaccctggaggcagagattgcagtgagccaaaattgtgcctctgcacagcagcctgggtgacagagcaagactccatatcaaaaagttaattaattagttaaataaaaataaagcccttatttggggaattgagcatcagtcatggctctgcttcccctgaagtttttttttttgttttgttttgttttttttttgagacgtcttgctctgtcgcctaggctggagtgtagtggcatgatctcagctcactgcaacctctgcctcccaagtccaagcaattctcctgcctcagcctcctgagtagctgggattacaggcgtgtgccaccatgcccagctaattttttgtatttttagtcgagacggggtttcactgtgttaggatggtcttgatctcgtgacattgtgatccacccacctcggcctctcaaagtgctgggattacaggcgtgagccactgcaaccagcccttttttttctttttaaatctgtagaacctttgagaaactggcactaacttctagcccagactatgttcctgaaaccagccacccgatgggacagtgcagatctgatctctaacagtgtcattaattttcttgcctaaagaaaatcagggccaggctcagtggctcacacttgtaatcccagcactttgggaggctgagggcagcggatcaattgagctctggaggttgaggccgcagtgagccgtgttcccagccactgcactccagcctgggtgatgaagcgagaccttgtctcagaaaaaaaaggggcagctttcagattcaggaattctgcaaggtgtgtgactaccatctctctgggccccaagccgtaggaatttgatgggtttgtagcagacacgtgacaggaaattaagaatattttccatggcatgcacataactttgagacctttacacgtggatttttaggccaggtgcagtgaagtggctcacacctgtaatcccagcactttgggaggcagaagtgggtggatcacttgaggccaggagttcacaagaccaaactgggcaacatggtgaaaccctatctatactaaaaatacgaaaattagccgggcatggtcgcggatgcctgtagtcccagctgcttgggtggctgaggcacaagaatcacttgaacccaggaagtggaggttgcagtgagccaagattgcaccactgaactccactctgggcaacagagtgagactctttctcaagaaaaaaaaaaaaattaatttttgtttgttttctttctacgagacagggttttgctgtgtcacccaggctggagtgcagtggtgcgaccatagctcactgcagcctcgtcctcctgggctcaagccatcttcctgcctcagcctcccaagtagctggggctacaggtgcacaccaccacccctggctaattttttttatattttatagaaacagtcttgctatgttgcccagactggtctcaaacctcctggctttgagtttgagaatacacctctgagactgtagtctgcttctcattgagatttctagaggtgagttttcagattaattttccaggcgatcttcccaccttgacctcccaagtgctgggggttacaagcgttagcaatcatgcctggcctttttttttttttggagacagggtctcactctgtcacccaggctagactgcggtggtgtgatctcggctcactgcaacctccgcctcctgggctccagcgatccttccacctcagcctaccaagtagctgggactacacatgcaggccaccacacccagctaatttttgtttgcatttttcatagagacagggtctcactatgttgcgtaggctgtaaaacaaacaaacaataggtaagagatggatttttctagtgggtctgagactgggcgttttgtgtgaccttggaatctgagagccaggtagccagtgtcctcttcttcatttcacaggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcaccgcagcctccgcctcctaggttcaagcgattctcttatctcagcttcccaagtagctgggactacaggagtgtgccactacacccactaattttgtatttttagtgagaaacggggtttcaccatgttggccatgctggtcttgaactcccggcctcaagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccaagattgcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaacaacaacaacaaaaaaacaccttttttttatagagacgggggtctctctcggctaggctggcctccaactcctggcctcaagtgattttcccatctcagcctcccaaagtgctgggattccaggtgtgagccactgtacccagccaccatctgacgttttgtggaaagtgtttgctgactcattggacaagaccttgtgttttaactcaaaaaatcaaggaaatcctgtatttttcttaagatactggttttgatgagtcaagatgttcttcccagtcatgttcgagggcagggggcagtggcccttagaccacacatcaccttatttctctcccctgccctccctgctgagcggcccagtaacccccttagacagtctcactttgcatctctgctctgctctctggctggctgtggggttgtaggcaattgatttcacctctctaggcctcagtttctgcattcatgacgttaaccctgacttcagagaatctttgggacgatgaagcaaaacccagccttccccaactccttttcctctatagaaaacagctcaacagaaaagccaacgacattgtgatttataaccatttattagtgaaagtgtttttaagcacagtcagggtgtaaacagtgcagcattcctgctcccctccgtgggagcagcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttgaatacaggggtagtaggggtggtggtggtggtggtggttgagacagggtctctgttgcccaggctggagtgcaatgatgcaattatagctcattgcagcctcgaagtcctgggctggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggatttagacaatgctaagtacagtctgctgggttttgctttgttctgggttgttgttgggttttttttgtttgtttgttttggtttttggttttcttgccgtggtgcaaaactgtagaaagttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgtgggttgtaagaaaacacattatttagcaaagaaatcttcatggttgggatagattttttataaatctattttaaacttgtagctatagtcctattgcaatataaattttttttatggcagaaaacacacacggcacaaataagatgcagatattcaagttgaagtcaacaaatcattgccagtcttaaggcatgagtgattgaatttaatcagctgaaattggttgcgggggtgggtggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggggctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagcgctggcattacaggcgtgggccaccacacctggccttcaaggtggatttaaaaaagaaatttaagagtctctctcacccaggctggagtgcagtggcatgatcttggctcactgcaacctctgcctcctgagttccagcagtccttgagcctcagtattgagtagctgggactacatgcacgtgcacactgccacgcctggctaatttttgtatttttagcagagatgggattttgccatgtgacccaggctggtcttgaactcctggcctcaaacgatccacctgtcttagcctctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagaagaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggaggctgaggcgggcggatcatgaggtcaggagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggtgagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccacttcaaagtaaacactcctagcccagcttcacagagaagcttctggacttgcagccctactagagaactctccatccttctctctctagatgtgacccttaagtctttttcttttttagcactgttttccaagcgcttgactcagaaggatgctcaaattcagcgcagaggagcagcagtttgactgttccctgtacgctccccacacagctctcttcgtcacagttttaactccaggttcaaaccctgatgggttggccagttgctgcgactcatgcctgtaatcccagcacttggggaggccgaggtgggcagatcactcgtgaggtcagttgttcgaggccatcctggccaatatggtgaaaccccgtctctactaaatatactaaattagccgtgcgtggtggcaggcgcctggaatcccagtcactcaggaggctgaggcaggagaattgcttgaacccaggaggtgaaggctgcagtgagccaacgttgtgccactgcactccagcctgggaaacagcaagactgtctccaaaaaaaaaaacaaaaaaaaatctgatgagctgggaagtagtccctaacctccacatcagtgctctaggcactctctttttggctcttggaagagtctatttgctaactggaaaagcttaatggataaatttgctcccttgacctaagaaatacattgtgccctgggccgttgaagctccttgcttggctgtcagcctgcaagatactctgttttggctgaagtgcttttcttggaactggtttcaaatcctagaccaaggttgacaccaactatacctgttacaggaactaagggacccccctaaaggttttcttaaagggtctgatcctggagaatctggaatttttttttgaaatagagtctcgctgtgttgcccaggctggagtgcagtggcgtgatcttggctcactgcagcctctgcctcccaggttcaagcgattctcctgcctcagccttccaagtaactgggactacagacatgccaccactcctggctaatttttgtatttttaggagagacggggttttaccatgttggccaggctggtcctgacctcaagttatctgcccgcctcggcctcccaaagtgctgggattataggcatgacccactgtgcctggcctagcatttggattctattcgtggactcagcttatccaaggcctcgggaatcatcttgagtgtaagcacctgctagtttgcaaggactcagtttcccactgaccagtgggttctgcacttcagcccaccctggaatttggcttatcctatgatcccaatcagctggtaggagagctgcttgaagtgtcctagaaactcatctgctcccccacaaaactggctcttaacaagacctcaccctgcgctttaagtattttggtagtgacagcaaagctgagattctccaaaaatgaagatggacacaaatgagggttggtttggcctctccatgaggtgaagtcagatccacatggcctaacttcacctgtgaaaagttggtcatgcttgtaatcccagcatttggggaggccaaggcgcgcggatcacctgaagtcaggagtttgagaccagcctggccaacatggtgatatcctgtctctaataaaaatacaaaaattagctgggcgaggtggcgggagcctgtaatcccagctactcagaaggctgaggtaggagaatcgcttgaacccaggaggcaaaggttgcggtgagccaagattgcgccattgcactccagagcgagactccgtctcaaaaaaaaaaaaaaaaaaaagcaaaatcccagagcagcagagacctcttcatgctttcttgggaagggccctgtgtgcatccttgagtcttgggtatccactccccagtccctgaacatgtacatgcccgtgaagcctccagaaaaggctctgccaggactgtgcttggctttgcggtggtcagcttccaccccgtgtgctgaaaatgcagtttgtagctagacatcactcaagccacgtgcagcccccggcatttgtcagacatcgcagtgagctcatttccttcgcagacaagcctgtgaaagctgaatcatgggaggactggttgccgcgccgcagttaccgtgaactttgtgatctctgacttgtgacccagaccagccaactagaagccaagtacgttctccaggaatgtgcccagatagtggaactgtcatattcattcagtgcagtgtcttcactggacaagggaggacagcactgctgagtgccctaaccacgtaagagtggcttttggcatgaaaggaagaaaaatccaagctacacacacagcctctgccatctcgtcaagatgcagtgataagggcgcacactgttgggtgtcatgtcacatgtgctgcccagaggcaggaaggacagtgggtcaagagatgaggtctatttgtcatcctgatcttggtttcaatgaaagctttgcacaaagatatccaagcctccagattttgcaagaatctcgtggaaatgtgcaagggtttaaaaattggggtgggcagaggggcgcattgggcagaaaagaaatggatactgagacaacacacagctgcgaagctgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcaggccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcacccggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggtaagtgggtctggctttagagagggcttgtgtcgagatgcgtctggctgatagaacttggtgaaactcgcactacagttccttcttggctgaggagccaggcatgcttaccaacctccctcagggctctagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagtttcaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccccttctcagaggggtttggacttttccctgtctcacgcagtggtccccaaactctagaggtgatttcagatggcttccgggcatgccatccgctaactgaactgggccctgagaaagtcatttcctttccaactctttttaaacaagtctaattatgatgtcagagagagtctatttggtgctaatggctgttgtcactccctttttagtggagaagtaggcttcaggtcttggtgatcaagttgtggccacaatagctagatattgaacttgatactatttttatcatattactttcatcgtaaccagttgatagaggtgatgctggtttaaaaatatagaggaggtatgtttatttgccgttatattcatgtatgattaaaactgttaaaagatcaagtcattggtattaaaggtagtaagaggctcagcacatggctgtggtggtatgagaatgaagcggggaaaatatctaggacccgagggataaaggttcactctgcctggtgctgtcctagacactggagattttttttttgagaccgagttttggtctgtcacccaggctgaagtgcagtggtgcgatctcagctcactgtaacctgtgtctcccaggttcaagcgattctcctgcctcagcctccctagtagctgggattacaggcacgccccaccatacccggctaatttttgtgtttttagtagagacggggtttcaccatgttggtcaggctggccttgaactcctgacctcaggtgatcagcctgcgttggcctcccaaagtgctgggattaaggggtgagccactgcacccagcctgggcaggattctttagggaaagttgaccagattctcccatagatgggatgtggggtataaaggagaccaaaacgttaagaaggaccacgaggtttgtgatgtgaattgttggcaacttcatcattttagctgctgagctggagagaggagccagtttgggggtgaagagtttcagtcaggacttggggtgcagcatgtttggtgtgagctgcctattagacatccatgtgggaacgggagggtggtctgaggttctaggaagaagctagggcttctcagagatgaactgaggagtcattagatatacatggaattctaaagcgccaagattagttgagacctctcacctagcgctggggagagatgaaaacaactaaggccgtgcagtggtccatgcctgtaatcccagcacgtggggaggctgaggcgggtggatcacaagatcaggagttcaagaccagcctgggcaacatggtgcaaccccatctctactaaaaatataaaaataggccaaaaatagcttgaactgggaggcagaggttgcagtgagctgagatagtgctactgcactccagcctgggcaacagagcaagactctgcccaaaagagaactaagttgataccctggggcggtctagtggcaagcaggtttcgaggtgagggatcagcagaggagaggaagagggacaaccccacaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttctgggagagtgatgggtgggggcgaggggaaccagcaactcttcacatacagtttttttttttttgagaccgagtctcactctgtcacccaggctggactgcaacctctctctcccggttttaagccattcttgtgcctcagcctcctgagtagctggaactataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcacggaggtaggatgatgaggcagtgggagcttgtgcacgtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaatgattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtggtgtgggagacaggaagcccggagctaaaacctcctgggagccaatcgggatggatggacagggtggtggaagcagcccttgggagcaggggggacccccaaggtaccagaggcatgggagagaaaacagcccccactccagtgacagcaggaattctcagcggggtggcagtcgtaccctcccatctctagaggacttctggcaacatctagagacatttttggttgtcacattgcagggtggtgggggactactgcagccggtgggtagaggccagaaatgtaagcacctgctacttttcagggatctttttccttctgatggggaatgtcggacagcccccatacccgagaataatgcagcccagatggcagcagtgctgagggggagaaaggaggagcagagcatgtcaggaaggaggtgaagtggcggggggtggtgttgcagcttcaatggatgtcgtgaagactcagtgatgcaatgaaggaggggctggaggagacagtggggatagcctcttcctcctcctcagccggaggaccggatgggagacggtcgatcgttaaaggatctagaaggttagctgctaccaggcaaggcagggcccgggtctgatctcagtgcctggcccacactaagcttagtgattaaggagaagcaggaataaaccacagaagggagtggcggctgtgggcacaaggggcatttgcaggccgaaaggagcccgagcccccagtgcttttctctggcctgagagacggggtcctcccgggccacgggctcctcacctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgtcgcggagagttggaggggtggttaggggaggccggctgggggctgggggctcgagggaggctgggtggcaggggctacctgctccttgtactgctcggccatcttgcgctcgtcctccacctgcagcaagatttccttcagcttcttgtctttctgcttcagcgacttggtggccgcctgtttctctctgcaaacagcaaggaaaacaggtggtttcagcggagggtggcaccccttgtagctggtgtgtcacctggaggtggcatcttgagtgctttcctgagccccgtatctggactcctctcaagaatcagtcagatggtggaatagtattcagccatgaaaaggaataaagtatcaatgcatgccacagcatggatgagcctggaattcttgccaagtgaaagaagacacatagcagacaacatagtgtgtgattccgttgatatcaagtgtccagaatagataaattcatagagacagaaagtagattatggttgccagggactgaagggagtggttacagggcatggggtttctattttttttgcggggaggaggcaaggtcttgctgtgtgacccaggttggagtgcagtggtgctccaatgcctgctcttcaccctagttcatagttcactgcagccttgaactcctggctcaagcaatcctcccacctcagcctcccaagtagctgggactacaggcgtacaccagcatgctcagacttttaaaagtttttcatagaaacggagtctctggccaggcgtggtggctcatgcctgtaatcccagtactctgggaggccgaggtgggcagatcacctgtggtcaggagttcgagaccagcctggccaacatggtgaaaccccatccctactaaaaaatacaattacaagctgggtacagtggtgtgcacctgtagtcccagctacttgggagggtgaggcggaggttgcagtgagctgagatcgcaccactgcacaccagcctgggaaacagagtgagactatgtctcaaaaaaataaaaataaaaaagtcttgctatgctgcccagactggtctcgaactcctggactcaagtgctgctcccacctacctcagcctcccaaagtgccgggattatgggcatgaaataccacatatggcctggggtttctgtttgagccgatgaaaatgttctcaaaatgactgtggtgatcgtttttacatgtttgtgaatatatgaatagcccttgaattatacactttaaatgggtgcattgcagggcgtgcgaattactgaaaaagctactagaagagaatgggtgagaatccttagaatccaatggtaagaaatgtgctgtgatcatatgcctcattcgacccataattaagaaggcttccagtgtgtgtaccaaatgggctgccggttggacttttgttttttggggttttttttgtgtgtgtgtatgtgtgtggaagggtcccactgtgtcacccaggctgcagtgcagtggcacaatctcggctcactgcaacctccacgtgtcacgttggagtgattctcctgcctcagtctcctgagtagctgagataataggcatgtgccaccacactcggctaatttttggtacagacagggtttcaccatgttggccaggccggtctcaaactcctgacctcaagtgatccacctgcctcagcctcccaaattgctgggattacaggcgtgagccaccacgtccagcctggttggatttttgatctgtcagcatgctatccctgcagaggctgggaaaagtcatatgtactgctgggaaggcaggttaatgtcaggaggaccatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctccagctgtgcaatcttggcctccagcgccgcgatggtggacttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaaatcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagaggtgcttccacaagtgtcagtgccacccaggctgagcgagtgacttgtcccttgctttctctgtcctggagtcgcctggagaatgatgcctgttcaccctacaccacaaggggctgcaggttactggatggtccctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcgtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcggccatggtgggggcctctaccctcccccgccttaaaagatgccccctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacaggcatgaaagcgctgacggaaaacctaaccaccatgggtctgtccccaatctcagaggacgcttcgtcagcagcagcattgaaatgggggtccagggccaggcacggtggctcacacctgtaatcacagcactttgggaggccaaggtaggaggatcacctaaggtcaggagttcaagactagcctggccaacatggtgaaaccccacctctactaaaaatataaaaattagccaggcatggtggtacacacctgtagtctcagctactcagaaggctgaggcaggagaattgcttgaacctgggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaagccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccagttcagctttgcacacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttcggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcactgcaccccttccccagcacagcccccttgtgaggtgggcatctcatccccagttgcagatgagaaaacggaatcacgccgggcgtgggtggctcatgtctgtaatcccagcactttgggaggccaacaggagaatggatcacttgaggccaggagttcaagaccagcctggccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctccccggcagcacgcacctgtctctgcagttgcctcctcttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctatgaggctcaacttcatgaagacgattgagaaacccaccgtgagcggcacctcaggagatcagggaggtggctttggcctcccacaggatgcatggccgggactcaagatgacccctgagagttcagaccccagccttatcctcggaccccccaactcagacccatcctcgactgccattctcagcccctcccagcccctgcaccagtccaaaaacctccttccatttccgatgatagttcgctatgaaaaaggccaggagctagcctcgcatggactggtgaatagcacagagggtgggcaggcgaaacatggacgagaaaaaccacccagagccacttacgttcttgcccacgtcatccttggagctgaccaggtcttccatttcggctttgagcattttgttggtccgctcgagttcctctttggcttccaaggcctcttcaagggcccgagccagggacagggccttggtttccttctccctggcttctgcctcagctctgtccctctcatccgcgtatttggaagagatgtttttctcctcggctaacaactacaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatcttacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctataatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctccgcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgctgggattacaggcatgagccaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagcactgcccaccacaccaccgcgccacctcctcacctgcagcttgtggactttgtcattgagctccgcccgggcccgctccccatcgctgcacttggactgcagctcctgcacctgcgcctccagcttcttcttcttatgttccacctcctgcttggcctggcccaggacccgcagctccccggccaggtctgcgttctctttctccagcgtctgcttattcttgtctaggttcgccttggcctggcgaaggaagcagaggggagggataacagggaggctgtggccgggagaacgtttcaggccctgccctttcctccctcagagaggtccaggaaggcacacaacagggggcacacaatcaccagtaagagatttggggtttttttgttgttattttttttttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagacgaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcccagcttctttttcaaaaaactttaatgtttgaaggcatgccatggcagctcatacttgtcatccccagcactttgggaagcaggcagaaggatcgcttaaggccaggagtacaagaccagcctgggcaatgtagtgagacccccatctctactaaaataaaacattagctgggtgtggggggcacacaccagcaatcccagctactcaggaggcggatggcaggcttgcttgagcccaggaattggaggctgcagtgagctatgatcacaccactgcactccagcctgggcaacaaagtgagaccctgtttcagaaataagtagctttgggaggccaaggcaggtggatcacttgaggtgaggagttcgagaccagcctggccaacatggcgaaactgcatctctactaaaaatggaaaaattagccgggcatggtggcgcacgcctgtagtcccagctactggggtggctaaggcacaagtattgcttgaacctgggaggtggaggttgcagtgaaccaagatcatgccactgcattccagcctgggtaacagagtgagactccatctcaatcaatcaatcaataactaacattctatgtggtgactgtggtggtggtagttacacaatacacatttgttaaaattaatggagcagtaaaatggataaattttactacatatgcctcagtaatcctaaacttaaaaacaaaaacaaaaaaccaacaacaacgaaagatctggaaacagagggtcttgctttccttcaaggcaacaatctgccacatctaagtagcggctggctctgcaggtggggcagtcacctttcaccgcccccgtccttcacaggtgtcgtgtgattgacactgctacttctgtcctagttaagggaaacttattttatggaaccagctcctgtaggcatgtgagttgccctacaggaaaaaaaaagtgtgttggggccaggcgcggtggctcaggcctagaatcccagcactttgggaggcctatgcaggcaggtcacttgaggtcaggagtttgagaccagcctggccaacatggtgaaaccccgtctctactaaaaatataaaaattagccgggcatggtggcagtcacctgtaatcccagctgctgaggaggctgaagcaggagaattgcctgaacccaggaggcgggggttgcagtgagccgagatcccgccagtgcactccagcctgggcgacagagtgagactttgtctcaaaaaaaaaagcgtgttgggcaaaagtaggacgcggtgaggggcttctttccaggttgtagagaaggggaaagagaagcgcaagtatcccgagaggacgagacccaccactcagtcttcccatagtccctgggaggtgctggacgttgaccggtcagccctggatgcccgtcctccctccaagacatgactaagagctgccagacctcagatggggacagggagtctcttggtggtaacaaagcagtgaagcggggaccctaggggacatgggctcccagaaaccttagcccagcctaagaccccagaactggggccaaaccgcacgagggcctggggagcccaggtaggagctgatgttaaacgtttcccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtatttttagtagagatggggtttcactatgttggtcaggctagtcttgaactcctgacttggtgatccgcctatctcagcctcccaaagtgctgggattataagcatgagccaccgcgcccggcctttgggggcagtttctaatggtttagcactatccctttggtgctgccctcatgagatctggttgtttaaaagtgtctggcagctccccattctctctcttctgcctgctctggtcatgtaaaacatgcctgcctccccgttgccttccaccatgatggtaagtttcctgaggcctccccagaagcagaagctgctatgctttctgtacagcctgcagaaccgtgagccaattaaacctctcttctttagaaattacccaatctcagggtggtgcagtggctcacacctgtcatctcagcactttgggaggccaaggcaggtggatcacctgaggtcaggagttcgagatcagcctggccaacatggcaaaaccccatctctactaaaaaaaaaaaaaaaaaaaaaaattagccgggcatggtggtgtgtgcctgtagtcccagctacttgggaggctgaggcaggagaatcatttgaacccaggaggtggaggttgcagtgagccaagatcacgccactgaactccagcctgagtgacagagtaagactccactgctcaaaaaataaacaaataatccaatcttgggtatttctgtagagcagtgcaacaacggaccaatacactagtgatagaaccaaatgcaaattccccaaaatttttaggcaatgctgcacccacttaatctagcagaaccaaaagcttccactgaaggggatgtggaggagctgcaacgctgagggtaatgtaactcaggctttcaggaaaacaatctggccgaaggtcgcaagctaaaaaacttaccctggggaatgaagcacaggcactaccccaaaggagagaagagcacccaagattcagcattcggtactgctatttaccagctcccactcccatacaccgcaaagagttccaacaacgggagagtgatttgacctagtcattctcaaattatgccggagagagctgttctgccattgaaatcaaataatgacaagtttcctccagtcttttttttttttacaaaagaaaaatcgctatgttgcccaggcgatctgaaagtcctgggctcaagcaatcctccctccttggcctcccaaagtgttaggattacgggaggcatgagccgccatgcctggccttcctccagtctgcagagaaattaaagtggatagaatgatcccagttttaagtttcatttaaatctccccgaaagtgttgttacacctttgcttatccctgaagggcagtatattgataggccccacccatcctataggccttcagtcctgtagaggccagaaagtggggtctaggaccagactgtttgggtgcaaatcatggctctgtcacttaccagcagtgtgaccttgggtaagtctcttcacctctaggcacctaggacctcagtttctttgcttgtaaaatgagtttaatagtacacgtctcacagggtggttgtgaagattaattgacatactgtatgagaagcatttctattcattcttttttttttttctttttttgagatggcggctcactctgtcgcccagactggagtgcagtagcacgatctgagctcactgcaacctcttcctcctgggtccaagtgattgtcctgcctcagcctcccgagtagctaagattacaggcacatgccaccacacccagctaattctttatatttttggtagagatggggtttcaccatgttggccaggctggtctcgaactcctgagctcaagtgatttgcccgccttgcctcccaaattgctgggattacagacatggtgagccaccgtgcccagcctatttttattgtttgattaaggtctcactgtgtcgtccaggctagagtgcagtggcatgacagggctcactgcagcctcaacctcccaggctcaaacgatcctcccacctcagcctcccaaatagctgggaccacaggaatgcactaccaggcctggccaatattttattttattttatttttttgagatggaatcctgctctgttgctcaggctggagtgcaatggcatgatctctgctcactgcaacctctgcctcctgggttcaagtgattctcctgcctcagcctcccgagtagctgggattacaggcatgcaccaccgcgcccggctaattttttgtatttgtagtagagatagggtttcgccatgttggccaggctggtctcgaactcctgacctcaggtgatccacccagtttggcctcccaaagtgctgggattacaggcttgagccaccacgcctggcctacttttttaaaattttagtagaaacaaggtctcactatgttgcccaggctggtctccaactcctgagctcaagcgatcctcccgcctcagcctccccaagtactgggattacaggcgtgagccacctcacccagcctgtatgggaagcattttgtaaataaatataagctgctatcatcatcattagaatcttatgtaacttgttttttgtctttatgcagaccctgacctgtagtaatttgaggctgctgatgtcactcttatgtgtcatcaccaaaaagcatcaccaaaaagcattaccctcttgaactgctcaagctgctctgtgagctcctccaccgcctgtgcgtgtttctgcctcatctcctggacctgagcctcatgggaccgcgtctcttcatccagggccttcttcagcaccgtcacctcctgctccctcttggcccttggtgggaggaacacagtgaatggcagttgggtggagacagagggtcatctcagtgccgtgcaaaagaatgagagctcttccaggacccagagctgcagtcctcatcaccacccctctctagctgtgtgaccttgggtcattcacctaacatctctggacctaaaatttcctcagctgcaaaatgtggagcatatcacctgcctaggacatctgtaatgactggcaaacaaatacacaaagtaatagaattgaaaggatgtctgtgaactgcaaaattttgcttaaatattaatgttggctcttatttaatgagcagttactatatgccaggccctgagctaagttttttatatacatcatctaatcctcagagcaacccaaagaggcaggtgtgttattatttccattttacaaatgaggaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcgacagcgcaatcttggccccctgcaacctccacctcccgggttcaagcgattctcctgcctcggcctcctaagtagctgggattacaggtgcccaccaccacgcccggctaattttatatttttagtagagatggggtttcaacatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagactggagtacagtggaatgatgtcagctcactgcaacctctgcctcccaggttcaagggattctcctgcctcagtctcccaagtagctgggattaccgacgcccaccaccacgcccggctaatttttgtctttttagtagagacaggttttcatgatgttggccaggctggtctcgaactcctgacctcaggtgatctgtctgcttcagcctcccaaagtgctgggattacaggcatgagccaccatacctggcccatgcactgggctcttctgtatcaaaggccaagcggcaagggagcagaacgctgtgctctatgtgcatgtgacactgcacaaaacccaaagtgggggaagtaaaccccagggtatatggtgttggcacagctagcatagctatatgctatgatacatgctatgccaacaccacagattgcatcaaaatacatttatgtgtttactgaatgaatcaatgacctagtttcactagagtcaggattcgtgatctggcaggcagtttgttattgtttgttcatttgaagtgaatcttcaattgaaaaccaatctgatcaattttatttttaaaatttaacacaaaagtgatacacacacatacttgggaattggagcttggggactgactgatacacacacagacaggaaggaatttctcaagaatgttaactggtgtgactaagggtgatttttttgttttttgtttttttttgagatggagtctcactcactgtgtcacccaggctggagtgcgatggtgcgatctcagctcactgcaacctctgcctcccagattcaagtgactctactgcctcagcctcctgagtagctgggatttacaggcatgcgccaccacgcccaggtaatttttggatttatagtagagacagggtttcaccatgttggccaggctggtcttgaactcctgacctcaagtgatccacctgtctttggcctcccaaagtgctgagattataggcgtgagcccgaccctaaaggtgatttttttttatgtctgcttttctatagttttcaaattgttctctgagtatatccaagcttaccaatgaggatggttttgaatgcagcctgacacagagtcataaactttcttaaaacagtatgagatgttttttccaatttgtaaaatttttttagttgatcagctattattagtgttagtgtatcttatgtgtggcccaagacaaatctttttcttccaatgtggccaagggaagccaaaagattgtacatccctggtatatactactcttctgatgagaaataagatgatgagggtcgggtgcagtggctcacacatgtaataccagcagtttgggaggcggaagtgggtggatcacttgaggccaggagttcaagtccagcctgggcaacatggcaaaactccatctctactaaaaacaaaaaattagccgggtgtggtggcacatacctgtaatcccagctactcaggaggctgaggcatgagaatcgcttaaatctcagaggtggaggttgcagtgagccaagatggcacaactgcactccagcctaggcaacaaagccagactgcctcaaaaaaaaaaaaaaaagaaagaaaaaaaagaaacagccaaccatgcttctataagttaaagcaaaccgcggccaggaaggtaaatgcacaggggctgatgcacgatttgctttgggtttgtcccctcttctgcccccatcccattggtgcagtgggatagcaggatggtgggattgatgggcccctcacctgagctcctgctgagtggctgtgctgtccagtgtgtcttccagctctgtctttagggcctccagctcctcgccgaggtctcgcttctgcttttcagccttgttcctggcggcccgctctgagtccaggtcctcctggaggtctgagatgtggccctccagctcccggatcttcttcagggcattgttcttctgagcgatttcatcgtcaagccttccagggagagacccagcagaatgaacccccaggtcccttggtttcctctcttacaatgtggccaaaaacttttctgggaccagacagttatgttgcagagacatcaaacaccttctatccatgtccccaggtctgcttcttgacatgccagactatatgagattaacataggatgtgagtgccaaggtctgacatcaaaacaggttgtacatgtgcatgggtgtgtgtacgtgtgtatgcacgtgtgtgcatgtgtgtgcaagaatgcaaagcattgaccccagactggcaaggtacctggtcacagtagggactgtgtagatgctttctgaatgttggacagttcttcttccctggcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccctgttaaatggcagaatgctgcaggagaggcaagcactttgattttactgtacttgtgaaagggcagcaacaagagagaaagtgaaatagttgggttggggtgagactgcagagggtggatgggctctgagggtgaggctaaggaaactggattttccctagtaagccagtgaagttaggtttttgttttgttgttattattgttttgagacagggtcttgctctgttgcccaggctggagtgcagtggcatgatcatagctcactttagcctcaacctcctgggctcaagtgatcctcccatctcagcctcctgagtagctgggactacaggcacacaccaccatgcctggctcattttttaactttttgtagggacagggtcttgctatgttgcccatgttggtctcaaactgctggcctcaagcaatccccccacctcggcttcccaaagtgctgagattacaggcgtgagccactgcatccagccagcaaagttttgtgagcaggttcctgccccagagagatgctttcccttcatcaccgtagcactgtcaacatagcacaaattggccgacaaaagagccaggccaggggatcaatcagaaagctttgaggcttaaatcccagctctgcctcttagaagcaatgacattgctcctgttgcgttacccctaggaggctcagcttcctcctcaaagacaccggcagtacacctggccaggtgtctgcaaaggtattgcttgaaaagaacttagcaccgagtgagcaggtaaataatcattcatagtggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtctagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccgccttgaccaagacagccactgcgaatgagcgaatgagcaggggcccaggggatacatggacacacagcaaatgccccttgccagccccgctacctggccagggccgcctgcagctcctcctccttcttggccagctgcatcttgagctctgcgatctgcgcctggaggtcagcgatctgctcgtggaagtcgctggcatcaccctccagcttccgtttcagcttctccagctcctgtcggctcttctcttccttctttagccgcactgcaaaaaccaaggtgctcttcaggaaggggaggccccagagagatgcccggaaatgagccttcctgcccaggcattttacccggaggagatgaacacatcccccaatcagtaaccatcatagtcacggtctggaccattatctcccgatgaacagcaccttatattgtcataatattattattagttgagatggagttttgctcttgttgcccaggctggagtgcagtggcgcaatctcagctcactgcaacctccgcctcccgggttcaagcaattctcctgcctcagcctcccgagtagctgggattacaggcgcccgccaccacgcctggctaatttttgtattttgagacagggtttcaccatgttggccaggctggtctccaactcttgacctcgtgatccgcccacctcggcctcccaaagtgctgggattacaggcgagagccaccgcacccagcccttttatcatattattagtgcatgtgatgactaagggtgatttcgagaggtggcatagagttagttgtcactcatgggatgatctgccatcctcaaatttcctttctgattttcctgcttttaaaaatacccattcaagcccaggaatagtggctcatgcctataatcccagcactttgggaggccaaggtgggaggactgcttgggcccaggagtttgagactagactgagcatcatagtgaaaccccatctctacaaaataaaaaataaaaaaaaattagctgggtgtggtgatgcacgcctgtagtctcagctgctcaggaggctgaggcaggaggatcactggagcttaggagtttcgggctgcagtgagccatgatcgcaccactgcactgcagcctgggcaacagagcaagacctcatctctaaaaaaaataataaaataaaataaaaataaatctcttggtagctggtttaccttccagttctgaaatcatagattcatgcttgtttttcagcttggtaagattcttggccttttcttcctcttctgcaagatttgtcgttaagtcactaatcctctcctcaaggagttttcgttcctttttggggaaagagaaagagatagctttaggatttttcttttctctagaatctatgtttcacttttagtgatttccatgtaaacagttgaaagaaaaacccacattataacaaaatacaactagagttttaaatggtaaagagaagtcccataacaatttccaaaaactggccatttctcatctcgtgccagtttgtccctcatattgtatggtcagctaaaggtaccctccttccattcctgccactggccagctcttccctgccccagggcctttgcacagtgggccaaccagctgagatgctcttctactcccctctaactgctccttcatctttaagtttctgcttaaatgtcacctcctccaggaagtcttctatgaatacccttcctctatcccccactgctgtattctttttttttttttgagacagagtctcactctgtcgcccagggtggagtgcagtgttgctatctcagctcactgcaacctctgcctcccacgttcaagtgattctcctgcctcagcctcccgagtagctgggactacaggcgcccgccaacacacccaactaattttttgtatttttagtagagatggggttttaccgtgttggccaggctggtctccaactcctgacctcaggtaatccacttgcctcagcctcccaaagtgctgggattgcaggcatgagccaccgcacccggcctgccgcactcttaaaatatggtgaacgtttccttcagagccctgatcaccatggtaaatgacgattatttgccatctcactacagtataaaccccacaagggaagggtcctccttcaccatgcatacctgcatctaacacagagcctggctcacagtaggggccaagctgacatccagctcaaagaactaaaagcaggtggggctggttagtgactactgactacggtgaccagcttgtcctggttttctaagggcttttctgctttgagaactgaaagtcccaaatccccaaaatctccctgatcctggtaagcctgttgtttttaatgcagaaacttgattccacttttttttttttttgaaacagagtcactctgtcacccaggctgcagtgcagtggcacgatctcagctcactgcaacctctacctcccaggttcaagtgattctcctgcctcagcctcccaagtggctgggattacagacactggccaccacacctggctaatctttgtatttttagtagagatggagttttaccctgttggccaggctagtctcaaactcctggcctcaagtgatccacataccttggcctcccaaagtgctcggattataggcgtgagccactgcacccggcccctactcacttttgatagtttattgttctgatcatccatgaccaggatctcatcctccagtttcttgatcttggcctcagccgtgaccttctcaagttgcagcttctgcctggcagcttcctcctcctccagctgttcttcaaggtcctttgttgtggagggaaaagagtaacagctttggttataacagatttactctcgtggtgatctggggactaatgaatacaggggctaggcctgaagatgcccagaactctgtagcctcctaaaaggaagaaataaaggcctgagcgtggtggctcacacctgtaatcccagcacttttggaggccgaggtgggtggatcacttgaggtcaggaattcaagaccagcctggccaacatggtgaaaccccgtctctactaaaaatacaaaaaaaattagccaggcatggtggtgggctcctgtaatcccagctactcgggaggctgaggcaggagaatcgcttgaacccgagaggcagaggttgcagtgagctgagatcgcaccatcgcaccccagcctaggcaagagagtgagactctgtctcaaaaaaaaaaaaaaaataaagacctgggtaagctgctctgcttcatggaacctcaacctcctcatctataaaatgagcacagtaggtaccatggtggttttaaaatctatccacaagttctttgcgactccaaaaaggtggagcctaattctcctccccttgagtgggggttagatttgcttctaacaacaacaacaaaaatcaggaagaagtgatggaatgtaacttcagagattaggctataaaaggcattgcggcttcctttctcctctctcagatcactccttctgggggaactctgctgccatattggaaggacactcaagcagccctgaggggagaggccttcatgataaggaactgaggcctcctccaacagctgtgtgaataagccaagtagaagtgggtcctccagccccagatgagccttcagatgactgcagcctcagccaacaccttgactgcaacctcaggccggaccctcagccagaaccactcacctaagccactctcaaattcctgactatgcaatactttttatttttagctgctgagtttggcatgttttgttatgtagcaatagctaacaaatacaattatcctccattcaggcttgctgttaggagaaaaggggttagcacatgcaaggcagggcaatagaacagagtgggctcactgtgttccagtcccaatcccagctgtgtggccttgatcagatgaccaaccctctccaagcccccgtctcatcatctgtcccagcagggacacatatccctggatgcacctccacaggcctgtggtgagggtcaagtgatttgctacccaccacgggctgcccctgtgacaccttaccagcatctgctgggccatcttcttcctttcagcctgtagctgctggcccctgtcttcctcctcctccaggcgggcctccatctcatgcagtatctcctccagctcctgcttcttggccgccagccgcacccgcatctcctcagcctctgcatacagctctgtctctgcctgcagctgttcctgtagcaggttcttctcctcggtcagctgcacgcaggtggtggggaggaggcgggtgagccccacggggccaagtcctgttccccagcaaccccagccatgcatccatacaggtacctgcgagtgcttctgttccagctccttaagctcattctctgccttctgctgccgctccttggtcttctgcagttcatcctccttggcctgcatctcctcctcctgccgtgtcacctgcagcagtggcttcacctgcacacacacggttagcccatcatttgtttttgtggcaaagggatatgttgtcataataaattcgatcagtggttccgagccagggacaatgttgcccccaccgatccccactaggggatattgtctggagacactgctgattgtcacagctggggtggggggtgcctctggcatccagtgggtagaggccagggatactgctaaacaccctacagtgcacaggacagcccccacaacagaattagtcaccccaaaatatcaacagtggcaagactgaggagctctaaatcagagcaccagaaaaggtacaaagtgaaaggaaaaagtctcatcttccccactttagaaccatcccaacagagaactactgctgaaaagtgatatttccttccaaggacaaaagggagaaaaaaaatctttcatatcccacccacctccctatcaaagtcattattaacattgtttacatttccttcctggctctttttctatgtttaaaaaatagacttaagaccatgctgcctagttgtagaggctgcttttattatttaaaattatatgatacagacaggaacagtgatgcatgcctgtaatcccagcattttgggaggccgaggcaagcgcttgagcccaggagtttgggaccagcctgggcaacatcatgagaccccatctctacaaaaacaagtaaccaggcatggtggtgtgtgcctgtagtcccagctagtgaggggtctgaggcaggaagatcgcttgaaccctgcaggctgaggctgcagtgagccacgattgtgccactgcactccagcctgggtgacacagtgagaccctgtctccacaaataaaatttttttaaaaattataagatatgtattaccccatgctgttacatcattcttacaactttacatagccatcttttaagttaatttatttatttagcgatggtcttgttttgtcacccaggctggagtgcagtgacacaatcatagctcactgcagccttgaactcctggcctcaagcgatcctcccaccccagctccagagtagctgggactacaggcacatgccacagtgtccaactagacagctaggtagaagtcttttttttttttttttttagcagacctattcagtagccaaagccatcattttaatagctgaaaacattccattgatagatgaaccattattgaactcatcattcagctaggactggacactgaaattctgctattgtaaataaggccataatgaatgcccttaactcttgattttcttttctctttttcaggtggagtctcgccctgtcacccaggctggagtgcagtggcacgatctcagctcactgaaacctctgcctcctcggttcaagtgattctcctgcctcaatctcctgagtagctgggattacaggtgcccaccaccacacctggctaatttttgtattttcagtagagatagggtttcgccatgttggccaggctggtttcgaactcgtgaacccaggtgatcctcctgccttggccacccaaagtgctgggattacaggcatgagccaccacacctggctaagacgattttcttaggatagtttttcagaagttggttcagtggggacgaacatttccaaaaagcagcatctgctgtccttccctgggctgcctcctaactctttgttttcaagcccctgcctggcacaaggaagcccctgctatgtactccagcagcttgcttcatgcacttatcacagtttgccattatgtatctgtctctgtgattatctgtttattgtttactccccaccaattcggctagaatattcatggaggtcagggaccatggtgtgtgttcacagctgcacccccagcacctagcatgtgcctgggatacagcaggcactcaatgtctgtttgcttggtgaaaaagccttgcaccagtggatacactcaagggcatataaggagaagcctagtctattgcaacagagcatgtctttgtgccatggggacaatgcaaccagtgccactacaggaaccagttgagtcctctggaggccctgactctgccagaaataaaaaataatatgctatggccagatgaggtggctcatgcctgtaatcccagcactttgggagcctgaagcaggagggttgcttgaggtcaggagttcaagaccagcctgggtaacagagtgagactccatttcaaaaaatgcaaaaagtaaaaaaaaaaaaacctgcagtattgatacatgcaacagtctggatgctctctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacatttagtagagacagggtttcaccatcttggccaggatggtcttgatttcttgactttgtgatccacccgcctcggcctcccaaagtgctgggattacagccgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatttttgtattttaagtagagacagggttttgccatgttggccaggctggttttgaactcctgaccgcaagtgatccgcctgcctcggcctcccaaagtgctgggattacaggcgtgagccgccgcccccggcagcattcttgaaccatcaaaattacagaactggagaacagagtggtttccatggctacggaggaagtgggtgtggctataaatgggccacacgagggattccagtgcggatggaaatattaatactttgtgttaaggtcctggctatagcctatgtgccaaaggacagggcctcctcgggccagagaaccgccaatgctcaaggtctgagttcgagccctccattccacacccacttgcgaccacctcctgtcccaaatgtgaaggctccagagtgaagaagcagggctgggggcccctgggaagggggctggggcagagcactcactttggtgaaaagcctccaccactgccagttccgcagcttgaggtaggcggcgcagttcctctgaatcaccttcatggcggtcagctgctgctgcctcttggcaaaagccctagggaggggggaagagaaggtgcgggggtcatgaagccacaccctgctgtcaacagagccctgccctgcagcatcctgaacctgcacagggacatgccccaatctccccaactcaggttcttccagaaaccctgtgtgacacatgtgttgtctggctgcaaacaacttaaatcatctacaggacagagcctttttcagtggacaaggaagacccagggctcacaacatgccctggacttagctgagatccaaacaccactcagaaaacacaactatgtgcatcattcctaagggggctcccgtactccccagctgcactagctgtttcttttttctttctttcttttttttttttttttttttttgagatagagtttcgctcttgttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggattacaggtaggagccaccatgcccagcctacaccagctgtttctgactaacttatttatttatttgtttattttcagagacagggtctggctctgcggcccaggctggagtgcagtggtgtgatgatggctcactgcagcctcaaattcctgggcttaaatgatcctcctgcctcagcctcccaagtagttgggactacgggcacatgctaccatgcccagctaatttttaaagttttttttttttggtagagataggggtctcgccatgttgcccaggctggtctcaaactcctgggctcaagcaatcctcctgcctcggcctcccaaagtgcctgggattacaggtgtcagctaccacacccagccctgtcaaacctattctctcctgggttgttttaggaatttcacactgtgaccctgaaccagcactcttcccgtttaagggctatcgatagattgagaaacgatagaacagtgaacgtaattctgtcttccctgcttggctgccatcttggacacaggaaaactttaagaataaaattgccccagttatccaggaaggacagcaacagggaacttagtaacgaaacttgacaagttaggtctgttgcgggagggccaagagctcccaaagctggccttgaccatcttgggtccatgtgtcaatgaatgaacctgacacatcagggtcctactggtgagggtgtggtctctgcccaatgacaacacacaccccagacagagagcgaccccacctgtccctgcagtccctggggtatgactttcattaaggaacccgaacccttccccggctcccagtcttcacagaacagctgggacatcacaccctccaaaaccctgccttataaatcccactgggacacggggatctagacaccgtcaagtcctctttcctcaatggtttatccaattctaacatgtctaggctgggcgcagtgggtcatgcctataatcccagcactttgggaggccaaggcaggtggatcacttgagaccaggaatttgagaccagcctggccaacatggtgaaactttgtctctactaaaaatacaaaaattaggccagtgtggtggtgggcgcctctaattccagccactcgggaggctcagacacgagaattgcttgagtccaagaggcagaggttgcagtgagttgagactgcgccactgcactccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaagctcagagaggtagagtaacttgcccaaggttcatcagcaaaaactggggcatccacgatgagaacccaggtctaaaactcgttcccttcctgcactcgtaacttggtacatttatttaaagtagaagcatttcttccccttcaagaaaaggctgtcattcagtcaatgatgcatcttaaacaggtggcctcttagaatcagggaatcagaacagaaaggcccctgtttgtgattcgcgtttgaggtattaggatgcaggaaagcatctttactttctggccaagtagccacgacacatcgcctggaaggccatgatgacatcggtgatcttcaaatctcgctcctcctctaggtgggccaggacgccagttcggaagaagattttgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttggggatggcattcgccgccaggatctcgtagcttgaaacacagagcagaagtcaccccgggtacctccagcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacagaagcacccaaggagggcttagctgagggccgaggggcaaagcagtgcccccctctgggttttcatctctttgcttcggcaatggctgcctcatgatctctctggttcttggtgacactagcatcgcctggctggaacctggggcttcctcctcatcacctcgtctccctcacttcctgtccatcagcagtttgattgcttctagctcccaaatatctcccaacccccccacttctcttcaccaccattgtctccactatcttctcctgcctggacaaccacagaaaccacccacctggtctctctctctggtcttgcctctcccctcaatccctttgtcctttttattttttgagatagggtcccattctgtcagccaggctggagtccagtggtgcgatcatggctcactgcagcctcaaactcctgggctcaagtgatcctcccaaatcagcctcccaagtatttgggaccacaggtatgtgctaccatgcctggaaaatttttaaaaatgtttttgtagatatagggtcttgctatgttgcccaggctagccttgaacacctggtctcaagtgatcctcccacctcaacctcccaaagtgttgggattataggcatgagctagcatatgcccagccccctcattcacttcctaaaatgtaaatctgaccatgatatagccctgctttaacacccccaatggcatgcctagagagagaaggccaagctccagaaagaacacaaggagcaccacgatctagcccctgcctacccattcagcctcaatcctacctcacaccatctgattcctacctcatgccatcacacatttgcaacatgaaatgacctatttagcattttctttccttttttttttttttttttaagatggagtctcgctctgctgcccaggctggaatgctgtggtgcaatctcagctcactgcaacctccgcctcctgggttcaacagatttttgtttctcagcctcctgagtagctgggattacaggcgtgagcaacacgcctggacactatctagcattttcttacctagttccttcacttctcacctccacactcttgcttagcctgggccctctgcttatcctaggccccctgcttatcctaggccccaccctgccttccatgtcaccaagttgatggccacacattcttaacgttcaagttcaccagaagctttctctgagtcctgaggctgtgggaggagccctggctctttggtgttctcctaactgaccacattccatcaccatcatcagctgtatgtttacctctccccgtgtctcccataacctcagcactactggcatcttgtagggattctgtgctgggggttgagggaccatcctgtgcattgtacaatgcttagggcatccctggcccctacccactagatgctgactaacagccccctcctggttgtgacaaccaaaaatgtctgtagcatgtccatatagaggacacaatcgccccaagctgaagatgcctgcaccagattatgagaaacccacagggaagggctacaatttttctaacactgctccccagcacccaggacagggcagagcccagtgaatacttcctgggataatgaatgaatgagtggctggatgacctgcacagcaactccacaactgaaaagtctctggatgcatcctcccttcctccttttcctccagggatggggaatgggtctgagattcagatagccttccccacatggaaaatggggtcctcggggtaggtgggggcagagggcgccctggggacgctgtgaccgcttgggacagccctggcttctgggagccccagggtctgggcggcgggcctcaccctcttctcgtggttggggatgatgcagcgcacgaagttgggcgtggtgttgcgtagcgtggtcatcagcttgcccagctgctccttgtacagctgccccactgtgcggaacatgcccttcttggtcttggaggcgctgggcagcgagctctccgtcatcttggccatctggtccaggcccacgatgcggtccactatggggcacagccagggtggcatcagcctctggcccacccacccctaaataggccagaggctcagccccagccccacccaccaacctgcccactccaatctttccttccatcaccaacgcctccttcggcagtcagggtttccaagtattgtctattggggaaatcctgagagcacctgagtggcagaaagaacaaattccctgtgatggagtcacgctgacctaggagtcaagcctgctctcgctgtccactcactgactagccttggcttggcactatcctgtgcctcagtctccctttctacaaaagggaggtaataataccgtctaccttctagggcaggggtaaaaaaaaataaggcacagaaggcacttattccctgccagcctccaatctttcatccaccaacaaatagttattgaggaccttctgtgctccaggccctggggacactgctgtgaacaaaaaaagacccggccccctcaccccgcttatatcacagggaaggagacagacagagatcacagatgttaagtatggaatatcttgagtagtgaggtgtgcgtagaaaaataaaaatagggtaaagcggagagagagtgaagagggtgctctcttagacaaggaggtggtgggctctgctaagttgatatttgagcagaaaccagcaagaaatgagtgggtaaccatgtaggtatccacggaagaaatattctgaggcagaagatacagcacacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacgtccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcagtggcacgatcttggctcactgcaaccttcaccacccaggttcaggtgattctcctgccttagcctcctgagtagctgggattacaggcacccaccagcacacccggctaattttgtttttattttttatttttagttttattttttcaagacagagtcttgctcttttgcccaggctggagtccaatggcacaatctcagctcactgcaacctgcgcctcccaggttcaagcagttctcctgcctcagcctcccgagtagctgggattaccaccaccacgcccagttagtttttgtatttttagtagagatggggtttcgccacgttggccagactggtctcgaactcttgacctcaactgatcctcctgcctcagcctcccaaagtgctgagattacaggtgtgagccaccatgcgcagcctcatgcttgtctctctgcttgtctttgagagtctcatctctcccacaagactgtgggtcccgcagaggagggactacaggcttcatcatgtgtcctgggatgacacagacccagggtgcgatgttgttccctaggcccagagcctggcatatggttagggcacagctggcccctcctggagccctttttttagcatgcttaaaacaaggggagaccagtcctgtaagccccaggcccatgggccctgtgccaagaataaaacctgctgtggacactgatggccagggacaaacagcaaaccccctcccctcatcatcactccagcagctcttcacagggatcatctattcactggttctcaaagggagccggagtgtggtccctagaccagcagcatcacctgggatgaatgttttcaggcccgccccatccctggccccagacctgcagaattagatcttagggtaggcccagccatctgggttttaaaaagccctccaaagagggccaggtgcagtggctcacacctgtaatcccagcactttttgaggctgaggtgggcggatcacctgaggtcaggagtttgagaccagcctggccaacatgggggaaccccgtctctactaaaaatacaaaaattagccaggtatggtggtgtgtgcctgtaatgctagctacttgggaggctgaggcaggaaaatcactggaacccagaaggtggaggctgcagtgagccaagattgcaccaccgccctccagcctgggtgacaaagcaagactctgtccctaaataaataaacaaagccttccagggggtcatgatgcctgcttgagtttgagcatcactggtctaatttaaccctcataatacctctagtagagacggcaactattattgcatctcctgttttactaatgaggacaatgaagcttaatgacatcaagtgactcatccaagaccacagagctaggaggtggcagagacaagatacagtgaagtccttctgactctggacagggcagtctaactccccgtgcctggcatgctgtttctcctctattgcctgagccctgacctcaggacctcaatcccctcgggacatgtaggattgaggggctcagggacccccactcaggaagaaattgtttcaacgagacatcaccagcccatgccaatgctcttccttcccctgcccccatgtaaaggcctcccctcctggggcaggtgtgagagtcgggggacttgggtgttcaattctccagctcaaagcagaacatggacccgagcagagaaggccttaccgtccttccacaggtcggccacaaacttgtcggaggaggcattgagcagggaagtcacgttgtcattcagcgggtccatattcttggtcagccaggcactcgcattatagtccacctgccaaggacaccctgctggtcagaacccctgggaaactagaaacttagaaaccaaggccaggaccccagccctcccattgtccttccagatcttctgaggtcagagaggaaatgacgtttatgaccaccatgatgggactccacaaacaccagtgaagagaccaacagcccagggacctgtgcccacgtagtaggacatcagccagtgatagccattgctgggaaagcctagtttccattccatattctcctactaacgctgctgtggtagcctccctcctcctaagccagcacagtacctgtgagttatacactattaagagatttcatgacggcagatgccctcctgccgacatgcaaaactcccccctcatcatcttcccaatcatcctggtttagaaattaagcatggcagccaagcgtggtggttcacactggtaatcccagcactgtggaaggccaaggtgggtggatcatttgaggtcaggcgttcaagaccaacctgaccaacatggtgaaaccccatgtctactaaaaatacaaaaaaaaaaaaaaaattagccaggcatggtggtgcacacctgtaatgccagctactcgggaggctgaggcaggagaatcgcttcagcctgggaggcggagattgcagtgagctgagattgcgccactgaactccagcctgggtgacagagtgagactctgtctcaaaataattaaataaataaattaattaagcatggcatcctattttccactctctaatgagcataatttgtaactcagagatcctgatatatggatatacagaaaaaggacatataggctttttacattcctgactcaaacaatgacaatgcccaaagccgtaatttttactatggtgaatattaaatgaaaggaactgataatacagctttgctgggttatcatgggatgtgggttatcaggataataggtaggcttgatctgagagaagactgaaaataataataaaaaaaatccactgatgaagtagggaaaagaaaagtgttgtctctatatgcttaaaggaacatatacccccttgaatataggctaggagttgggaaacttttggtgaaggcccagatagtagatatttttggcttggcaagtcatacaatgttttgtttgtttgtttgttttggtttttgagacagagtggttctctgttgcccagtctggagtgcagtggtgcagtctcagctcactgcaacctccaacttcctgggtcaagcagttctcttgcctcagcctcctgagtagctgaggttacagttgtgtgcctgtaatctcacagctggctaatttttaaattttttttattttttatttttagcagagacgggctttcgccatgttggccaggctggtctcaaactgctgacctcaagtaatccacctgccttggtgctggggttacaggcgtgagccaccacacccagccaagtcatacagtctttgtcgcagctactcaactctagcactgtagtatacaaaagcagccagccatagacattatgcatacaaatgggcatggctgtgttccaataaaactttatttacaataacaagctgtgggccagatcggactctgttgccaggccctggtagagagcattgtttgtgcccatgatgcagtggaggtactgaggagtcaatagaatactacaattctgcaagccagactaagctatgtcctttgtacattatccaggactcttgagagccacagggcaagggcctatacaataacagccaaggcatgttgatgatgatgatgatgatgatgaatacaactatcatagatttccctggccagagcaggctggcaatagcaaactcaagaccgtgacatgggagatttttgttgaagccaggtgtggatgtattagtcaccccattccagttggccccgcctgttgggtataacttgtagcaggaaggatttagagtctatacaagaaaagcaggctgaggccaggtacagtggctcgtgctcataatcccagcacttcaggaagccgaggcagggagatctcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtgcctgtaatcccagctatttgggaggctgaggcaggagaatctcttgaacccggagggagaggttgcagttagcagagatcacgccattgcactccagcctggatgacaagagcaaaattccatctcaaaaaggaaaaaagattttagctgggcatggtggtgtacacctgtagtcccagctacttgggaagctgaggcaggaggatcgtgtgagcccaggaggttgaggctgtagtgagctatgatcgcaccactgcactccagcctgggcgacaaagcgagaccctgtctccaacaaaaacagaaagaaataactgtctggacgtcacggttggaaaacatgagagtggctacagctgatgccttacagatgcgtagacaaattacgaataggacttggttgggattcgcttagcagcagatggctttgcagtttccaggcagcccaaggttctgccactctcagactgtctctgcgctgagcagccactgggggtcccctgagacagagtcccctgggccctgtggctggtaccttcccagcataatggatgatggagaactcagtcttgtccttgagctgcttgggcttctggaacttggggtggctgccctgctccgtgcacagcttctccacgaaagacttgtccgtggctttggggaaccagcattcctcgtccagcagggccagcacacctggagggttgttctgtgggagacaagtagggcttgaatcagagagaacacccaacctcaggcattccatgaagagctggccaactatacacaacgcatgggcatccgccgagatctgatactgtatttgcccacatataaagatgagtttatgacccccatgcttccaaatctaccttcaaattaccctgtgcccaatggaccagtaacagggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccaggcccggctaattagtagaaaccctgtctctactgaaaatacaaaagttaggtgggcgtggtggtgcacgcctgtagtctcagccacttgggaggctgaggcgggaggatcacttgaggcagggaggtggaggttgcagtgaggcaagattgtgccactgcactccagcctgggcaacagagtcagaccatgtcataaaaaaaaaaaaaaaaaaaaaaaaagcaatggcagagaaggaaagggaagggaaagagggtagggaagaaaaaaaggaagaaaaaagaggatggaaggaaggcagaaattaaagaaaatacctttgatatgaaaatgtgggttaatggaaattgtaagagttcacaaggattcagcttacagcctttcaggactgggtgatggattgggtgggggaatgctatgtgcatggggagagtgtggggtccacgtcggctccacagaggccacacacgtgtacaaggtgtgacggagccccgcacgcccacgtgcccctcaccggtcgctcgatgagctcgatgcagggctgtaggtccagcccaaagtcgatgaagttccactcgatgccctcgcgctggtactcctcctgctccaggatgaacatggtgtggttgaagagctgctgcagcttctcgttggtgtagttgatgcacagctgctcgaaggagttcacctgagcacatggcgtgggggcggggcgtgagcatcttggtatgaagtcagaagacaaggagccccacagaagctccacccgacagcgcccccatggcccgcccacatcctgttctgccatcccagcacccagacagggctgaggccccaaaacatgctgcctagagtccaccagggctggtgaagttgatatcacatggccctcacacaccttaaagatgcttatctcctccatctgcacaaccatctatggatggacaaacctcgtaaggcacgctactgcatgtacagatgtggaaacattttacagatgtgaaaacagaggcgcagagagaaagtgactcggtagtacacttctttcgggacatctatcaatcttaaaacctcctggctgggtgtagtgctcatgattgtaatcccagcacttagggaggccaaggcgggaggatcacttgaggtcaggagtttgcgaccagcctggcaagcatagcgaaacctctctccactaaaaatacaaaaattggccaagcacagtggctcatacctgtaatcccagcactttgggaggccgaggctggtggatcatttgagatcaggagtttgagactagcctggccaacagggtgaaactctgtctctaccaaaaaaaaaaaaaaaagtagccaggcatggtggcactaatcccagctactcgagaggctgaggcaggagaatcacttgaacctgggaggcggaggttgcggtgagccaagattgcactactgcactccggcctgggcaacagagcgagactctgtctaaaaaaaaaaaaaaaattagctgggcacagtggtacactcctgtagtcccagctactcaggaggctgagacaagagaattgcttgaacccaggaggcggaggcagcagtgagacaaaattgtgacactgcattccagtctgggcgacagagcaagactctgtctcaaaaaaaaaaaaacaagacaagacaaaaaaaaaaccttccctttctctgagaactttcttcaaacccatgggtaaaggatccaatatccatgtttctactacatgaggtattgcaagctcctgcaaacagttcttggcttggaggtgaccatgtagcccaattcaggtgagtaagagtcagtgagacttaattccaagattttggttggaactgttagaaaagagatatgtgctttttttttttttttttttttaccaggattactgagaggcagtctggagctgtggcagccatcttgcccccgtgaggggagagcctgcttgagaatggagccaatatggaggaaggcagagagagagagagaacgatggcgggagatcagaccctgcctacgggatccagctacatgtctggccttctcagttccagaaaccaatgcatttcctgttggatttctgtctcttataccctcaatgatccacccttaactagacagcctcctaccctacagtagccatctacatgcctttctccaaaatcatgactcctccaagaaaaagcccatctcagacaaccaagaccatggctcttaggatcccaccgagctgtacctcaaagatctcaaatccagctatatccaggatccccaggaaggaagccccttgccgatgggtcttgtccagggctttgttcacgcgggtgagtatccagcggaaaaggcgctcatatgttgccttggccaaagcctctacagcaaagtcagcctgcagagggcaaccaggggaacccggttattctcaatgggctccattttcacataagccaggctggtggtgaagatttttattcttggccgggtgcagtgactcacactgtaatcccagcactttgggaggccgaggcaggtgggtcacttgaggtcgggagttcaagaccagcctgaccaacaaggcaaaaacccttctctactaaaaatacaaaaattagccaggcgttgtggtgcatgcctgtagtcccagctgcttgggggactgaggcaggagaatcgtttgaatctgggaggcagaggctacagtgagctgcgatggcaccactgcacccccccctgggcaacagagcaaggctctggctcaaaaacaaaaaacaaacaaacaaacaaaacctgacatgggactgtgaatattctagtattgaataaatgagggataaagagatggatgggtggatgcatggacagatgaatgaatgaatgaatgaatggaatgacagctggatgggtgatggatggacggacagatggacagatggctgggtcatggatggatggacagatggatgagtgagggatggagagatgatgggtgagcagatagatgggcagatgaatggatggatggatggatggatgaacagacagatgaatgagtgggtagaaagatggatggatggacagatgcagaggcagaccatgggtgaatggattaatgaatacatgaatgagtgaacaggtggatagatggatgaatggatggatgggtgggtgcatggatggataagtgataagtacatcattacctgttcttttgtctgagctttctgtaccacatctcgcccaaccttgatacgaggagtgaggatggatctggtgaaatctgtcacattaattcccatgaggtggcaaactttctgagcagctggatggagaaaagaaacatcgtgagtgcatcacaaaagaaatagcttggcaagaagacacatcgcatgggatatttgtgatctgtgaatacagcgggttctcttggggaaatgggacccgctgaccatgaatatagcttgaagtgtcctaaaggctgctgtcattagtggtcacactccccagtattttgctgagaggcaatgattggggtgggctgaagcaggccccagttgggggtttagggtcaggtagttctagtttcaagtccctgtcccttcacacttccaagtcatgtgactttggaaaagctctttaccctcccagcatcttgcttttctcagctttaaaaagggtcagctcttcggtaccttgttggtacccaggactaaataaggtaaagtatgtaaagtccctgagatagatagatttatttatttatttatttgtttatttatttatttatttttggagacagagtctcgctctgtcgcccaggctggagtgcagtggcgcgatctcagctcactgcaacctccgccttccgggttcaagcaattctcctgcctcagcctcccgagtagctggcattataggtgcctgccaccacacccagctaatttcttttgtattttagttgagatggagttacaccgtgttgcccaggctggtctcgaagtcctgaactcaggcaatccgcccacctcggcctccctaagtgctgggattacaggcgtgagccactggcccttgagatttatttaacagttacttagtaagtattaaatagttattaatagtaacatttattgaacagttactgttcaataaatatttctttcacccttctaggatatgtgttgcagcattgtttgcaatagcaaaatgctagagtcaacctaaatgctcttcttttattttgagatgcagtcttcctgtcgcccgggctgaagtgcagtggtgtgaccacgagctggtcccttaacatgaaaatagcattacatgctgctttgcatgtgcaaggcagagtaaatagagtgattttaggatttttttttccccatctcttggcaagagcactttttcatttctctttccctgaggtctttccttggcatccggattccattaatttgccagatttagggactctaatacataacaaacacctgagaatgaaactgccactgcaaaattataactgagacactgaacaagatctgacctaacggactccaccttgcttctaacctccaagctccactgaaccatttgtgggtgtaagccgaattaacttggcaggaacttagtttatagtttattttttatgttttggacacagagtctcactctgttacccaggctggagtgcagtggcacaatctcggcgcactgcaatctccgcctcctgcgttcaagcagttctcctgcctcagcctcctgagtagctgggattacaggcgcctgccactacgcctggctaatttttgtatttttagtagagatggggtttcaccatgttggcgaggctggtcttgaactcctgacttcaagtgatccacctgcctgggcctcccaaaatcctaggattacaggcatgagccaccacgcctagcctcttagtttatagtttaaaacacaagaaccctttcccaaaacaaacccccttcttgcctggagactagactgcctttgtaggaataacaaattagcccaaaggtttgaaattatggtttaggagtcctgtaactggaggctacaagagtctgaccctccctaaattgctcctggggataacatcactattgtaaaacctaagaccagtacttgagatatttttgcggaccctggcaccaggtggatcagctgacaccacccagatcgagaaactggctcatctgatcttatggcctctgtccaggaactgactcagggcaagaggacagcttcgactccctgtaatttcatctctgacccaaccaatcagcacccccaactcactggcctccccctaaccacattatgcttaaaaactctgatccacgaatgctcaaggagattgatttgagtaataataaaactctgttctcccatgcagccggctctgcgtgagttactcttactctatcgcaattcccctgtcttgattaattggctctgtctaggctgtgggcaaggtaaacccagtaagcggttgcaacaggtttgatcaaggtgggctctagggagcgggaaaaagcaacacaatatacagcctgggctgggaaataagaaacctaagttttgctctcagctcagccaccaacaagcatagtggtagccaggccagcttctcaaaacacaaaatactgtttatttgtgggtaggtttatcagatttagggggaaaattacaggatgctcagttaaacctgaatttcagataaacaagaatactcttttggtataatcacggtccaaatgttacaagggacataattaaaatttaaaaaaaggtttgttgtttacctaaaattgaaatttatctggacatcctgtattttatctggcacccctaattctcagggcaattgaggtctgtctccccaagacgaccacagataccgtaagaagagctattcttgtgtcatttcctgctgtatcccagtggcatattgcaggggcttgagaaatatttctttaacaaaacaattaagtggggtattttagaagagatggtccctcgggatcttgtctggtcactattaggggtaggacgtgatgactcttgcctgtaatcccagcattttgggaggccaaggtgggaggatcacttgagctcaggagttcaagatcagcttgggcaacacagcgagacctcgtctctattaaaacttgtaaaattttgtatttaaaaaaaagaacaaataaataaaactattaggtttgtttttttttaatccctgcgctctgattcaataactttccacatagggtcttgagcactgaaaagtttgaaaaagtgagtgataagaacctagtccaactgttgttaaaatcccagataccttcaccttgaaaaataaccagtggttaaatgtcacctcccccacccccccaaccccaaagtcattggtcatcaggaaaaagtggcaagtacctgtgttatctggcatggacgcctggtctgtgtttctttccttcttgaagacgatatttccaagctgcaggaccgatgataccaccttcaatatggctgaggtggggagagaagggcagagcagacacaaaggtcaatgccaaggtaccctggagttttggagcctaaagccactggggacccagagccagcttacatctttcctctgaagaaactagattctgagctcaatattttcatatggttgcttaaaaccttgcattacaatggaatgccacgcagcagggactggcaaattacagcccatggaccaaatctggcccactgcttgctattatacataaagttttagtggaaaacagctatactcattcatttacatattgtctgtaactatttgcatgctacactggcagagttaatgagttgcaacaaagatcgtctggcctacaaaggctaaagaatttactatctgaccctttacagaaaaatgtgttagcaacccctgccacagaacagtgagaatgaatgagctacaactaccacaaatcaaaactgatgtattggggccagcatagtgactcatgcctgcgaccccagcactttgggaggctgaggtgggagaactgcttgaagccaggagcttgatacagcctgggcaatgtagggagatcctgtctctaaaacaaaaaaaaaaccctgacatatcttccagacacaaataccgaacaaaagaggacagatggaaacaagaacatactgtctaagtccatatatagaccgtccattcaagaagaggcaaaactaatcgatgctgttagaagtcaggataatgattatccttaattgagggaagttcttagaaggtgcatgtgggagcttccatggggctggtggcattgtcttatttaaaatggattctagttacacagacgtgttcagtttataataattctttgcactgcacgctatggcatacacaattttctccatgtaaatcatatgtcaataaaaggatttttgaaataaaaaccctgtgcttcttacatactcttctgggtgtaacagatgcccatgttgggatgaagaagatatacatttgtttccacttgttgtccaggtgtctccaaacaaaaacgctgtgttcccagaatacttggaacctttctgactccatactcaggccatgttactgttaaaatagtttctatgtctgaaatccccataagaccatgagtttctggagagtggagggcctgccctaatcatctttgaatttccaaagcctattccaaggtcctgatacacatgggagggagggagagagatggatggatggtaggtggaaggtggatggatggatgaatgaataaatggatagaggatgggttcatggatgaatggacggatggatggatgggtgggtagatgaatgggtgaatgatggacggatgagtagaggatagatggatgaatagaggatggattgatggatgaataattcatggatagaggatagacggatgatggatggatggatagaggatagatggatagatggaatggacagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacagctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcactgcagaaattgggggccagataattctctattgtggggagctgtcctgggtatcatgggaagtttagtagcatccctggcctctaaccactagatgtcagtggtggttaccctgacagagttgtgacaaccacaaatgtcaccagatactactcaatgtcccctgggaggcaaactcacctctggcagagaaccactggtctaaatgaacaaagccaactaatgaggactgtggggacccaaggaggccacaaacccatctgaaggggccagcagctactccgtcattgccacaggggatataagccaagtgttgctggaacttctgatttttctagataatggaaacccagagtttttatgtgaagtgtacccatgttttttggtgtgtgtgtgtgtgtgtgtgtgtgtgtgtgtgtgtgtgtgtgtgagactgagtcttgctgtcacccaggttggagtgcattggtgcaatctcggctcactgcaacctctgcgcttcccaggttcaggggaattctcctgcctcagcctccagagtagctgggattacaggcgtgtgccaccacacccggctaatttttctatttttagtagagacggagtttcaccatgttggccaggctggtctcaaactcctgacttcaagtgatccatgtgccttggcctcccatagggttgggattataggccacagtgcccggcctacccatatttaaactttaggaaccaatttctaaaaattttgaaggttgtagtggccgatctctcctgtgggctcaggaaccattggtttgcactttctggtatagttaaatgtaattccagaaatgacaaaagaatgccaccactcccaggccataagagatgaaccttggggcagaattagcagacagcaaagaagtaaaccagtgaggagacacaacacagcaagggtggtgacggctggcagcatcctggtgtgctggtgcaaagcacgcgctctgcagttagagagtcctgagttcaaatcccagctttgcttcttataaatctcattatctctgaatttccaaatcctagttccgggtccagatacacatggggagggagggagatggatggatggcagatggagggtgaatggatggatgaatgtataaatgtatagaggatgggttcatggatggatgggtgggtagatggatggacggatgggtgatggatggatgggtgatggaaggatgagtagaggatagatggatgatagaggatggattgatggatgaatcatggatgaatagaggatagagactctacatgagtctcaataagtcccatgagcctcagtttccctatctgcaaaacggagatggtaacagtagtacctgcttcgtgaagtttaggtcttgtaagatgctgagcaagggcctggcctagtaggtgataaagagtggaagccacctatattaggttgaatgttggtctttctaaaatatgtccacctggaacctgtgaatgtggcctaatttggggggttacatttatttttttttcctttttgtggataccggggtctcactatattgcccaggcaggtctcgaactcctgggctcaagctatcctcccgcctctgcctccctgagagctgggactacaggcgtgaaccaccgcgcccagcctgaacgtggcctattttggaaaaaatcggtcttcgcagatggaatcaagtacaagatctcaagatgagatcatcttggattaacctggtgggccctacatttaatgtcaagtgtctttatgatggacagaagagaagacccacagagtagaatgccacatgaaggatgaggcagagactggagtgagacaagccaaggaaaagccaggaacagccagagccaccagaagccaggacagaggcaaggaacagatctccctcagtgcctccaggaggaacaacccctgccaacatcttgtcttttaaaaaaaaaaaaattttttttttttaaatttttagtagagaaggggtcttgctatgttgctcaggctggtcttgaactcctggcctcaaacgatcctcttgccttggcctcccaaagtgctgggattacaggcatgagccattatgcccggctcctgccgacaccctgatttcagaaccctggcctccagaactgggagagaataaattcctgttgttttaaggcatcaagtttgtgctaattttttacagtggccttacacctctcttcttgctgaggaataagaaacaggactttccaacatcagacatgtgtaccaccagggatacacaggatggacaatttaggtgattttattttttatcttcaaaatacattagaagcagtataaccaggccaggcatggtggcgcatgaggatatcttgaggccaggagttcaaggctgcagaacccaatgtggtggggaaaatcctggtgtcccctggtcacttggagcctcatgaagctccagcctgaagcctgacccacccccttctccataggccccttgatggagggtttggaagtagctcttggtttataaatggggttggtgtacatttaggactaagttggttcctatgagagttcgtcatttgcacgccatcgtctgaatgcttgctctgtgtaccatctgctccattatttgcttaatcattttctttaaatttacttccttctctttccttacatttgttttaatagaaaactttctctatcttcagtgacaaatcatcttcacttgccataaatagatggcaattataaatataaatacaaggaaaacagtattaccaaattctagctagatgcttggggctgccgaaggtgctgggcctggagtctggtctctgtggttaaaggggaaacaagtgccaaagtacattgagaacactggggactgggcatggtggctcatgcctgtaatcccagcactttgggaggccaaggtgggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccaggaggctcagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcagcttcgacctcctgggctcaagcaatcttcctgcctcagtctcccaagtagctgggactacagtgtgcaccaccacacccagttaattttttgtattatttgtagagaagggatcttgccatgttgcccaggttagtctcaaactcaagctcaagtgatctgcctgccttggcttctcaaagtgctggaattacaggcgtgagccaccatgcccagcaaaacaatttaaatggtctcattgttttctttcacaaggacagacaatgatttaataaaccctctattaatcaacctattttagtttgttccagtttttttctatttattttttttgtagagacagagtctcactgtgttatccaggctggtctcgaactcctgggctcaagcaatcctcttgcctcagtgtctccaaatgctgggattacaggcatgagccactgtgcccagcctgttccagttttttattatttaaataaaactatactgaacagtgtagtacatcaagaaaaaaggatttggtaaattcctggcacacagcaaatacttaaccattgttcattgttatttaaaagcaagattagaagcaaaactgacccctgtcccaaatgaaatgaatcattcttggagggcctatgtcattcagacaaggaggctatcagcactagattctgatgtgggaccctggccaagacccacatacaccatccatttgtcaactgacccatacagcctaattttccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaagagattaaccttcaacactgaggcacatctaacgcagaaggaaaatcgtttctggaaacacagtgtcccgaccaagaatttctttctgagctgtcctgttctcaagacccagtgtgtttcttggccattggttggatgattttgatcaatatcaattgatcaccagagcaacccctccaggaaaagcctgagtaaatccactgcctcgatcactccccctcccctaaaccctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagatagaagacaagaaattaggttctagaaaaatcttttgaacacctagatctcactgtacctgaagcttgaattcctgaactttttttttttttgagatggagtctagctccatctcccaagctggagtggagtggtgtaatcttggctcactgcaacctctgccttccgggttcaagcaatcctcccacctcagcctcctgagtagctaggactacaagtgtgcaccaccagccctggctaattttttttttgtatttttagtagagacagggtttcaccaaattgaccaggttggtctcgaactcctgacctaaagtgatccgcccaccttggccccgcaaagcgctgagattacagacctgaaccactgtgcctaacctccctgaacttctcaacattctgagttagtcactttccctttggtttaagccagctcgggttacttgcaaccctagttatacagccacttttctacaacacaaacaaaccacctagaataaaattcattttcctccttttttttttttttttttaatggaaggtggggaattcagagagcagaaatctgtcctgaccagagaagagttcttaacaggttccactggtatccaggcaagctaccctccagactcaaggtgtgaggcttacatagctgctcctcctcgctgaaacccatgattgccatggcctccacggtttcctggaacatctcatcatcctgggctgctgggatgggcacaaagccattggagaggaaggtgtagttgttgaagccctccaaaagcaagtcacctagaaggagaggaagacaggtcagggtcaataagacatacttctaatttcaacatgagaccgagatctggtcaagggtctgggccatcataattcctttccctttatcaaggcttgaaccgtttaaagccctcacgcatcgtcacgtagacagcctcaccaaccactgccagccttacacagcggtgcaggttgtgcactgctccagtgactgcagctgatatccagccttggttctgcttgctaagccacaatccctggcacgaagttacatttacctggaggaagggatgcctttacctcaattgtctagaggcaccctgccttcagccttcagagacaaagctgtcagaagagttagatcaacctttactcttttttttttttttttttttttgagacggagtctcactctgtcgtccaggcaggagtgcagtggcgcgatctcggctcactgcaacctccgcctcccaggttcaagcgattctcctgcctcaacctcctgagtagctgggattacaggcgcccgccaccacgcccggctaaattttgtatttttagtagagatggggtttcaccatgttgaccacactagacttgaactcctgacctcaggtgatccacccaccttggcctctcaaagttctgggattacagacgtgagccaccgcacctggccttattcatgtatttataaaatttttatcaaattcaaacaggcacatgagttttaaaaatcaattactaccaaaggtttataatgaaaaatagcattctcctgtcacatcccttctccaactctaccttactccataatacctgcttttatctcttttagctgctttttatctggcagttaccactatctctctgtacaataggcttgctatatatactagcctattataatgtatataccattatgtattacatatcataggccaagggttccccaacccataggccatagaccagtaccggtccatgttaggaactgggccacacagcaggaggtgagcagcaggtgagcaagtgaagctttatccgctatttgcagctgctgcccatcgcttgcatcactgtctgagctccgcttcccataagatcagcagcagcattagattctcataggagcgcaaaccctatcgtgagctgcacatgtgccctccttataacactctaatgcctgataatctgtcactgtcccccatcaccccccgatgggactgcaggaaaacaagctcccaatgattctacattatggtgactagtataattatttcattgtatattacaatgtaataataaagtgcacagtaaatgtaatacacgtgaatcatccccacaccatccccccaaccctgcccgcccagtctgtggaaaacttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttatactacctttcctttcctccagctatttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggtgtgagccaccgtgcccagccacccccagctatttttagttgaatcaatatataaggcttatatcacaggttggcaaatctggtcccctgttgtttttgtaaataaagttttattgaaacacagctgctctgatgtccttgtttatttctcatggctgctttctcactaggcaacagagttgagtagttgcaacagaggccatctggtccttaaagtctaaaacgtttactactgaccctttagcaaaaacagtttgccaactccctttttatgacattaattagatattctgtgtcaaactgtatcctatgattacatttcctttgttgttgttcagcttctcccccacccccaactttataattgcctttctttctcctgcaccatttgcttttattataccctccaatacatcaaggatcctcttccagatcaatctttaattaggatggattcggttatacttttggagagacgtcagcaagatatttttctttcaaaatcaaggtcttttatgggtcaagtcacttggaagctgcttgataaactcgaggttaaattgactgaaggcaccagttaactcaaacttttggattaacttgaaatgcctgattcaagtcacgaggattgaggtctttgccaagacttcattatcccgagtttggatgcatttagcaatatttggttctttctaaaagcctaacatctttccagttctatcatctagaatacaaacggcccctgggaatttagttctgagccctatacttgcccatttctggaagaccagaggcaaagcacaaaactggaacccaaggtaccaaacaaccaaactgttttcttgggtgccaaataaaaggaaaaggaatgtcaacatttttccctggcccattccacagggtcctgcactgtaactgctaatataccatgtttgctggtacataaaaaatccattcagcattccccctttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgcccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactctactatgtacagatagtcactgatccattccttttttaagctatgcgatttgtatatatttttaagagttagtaaacagctgcaggtccagaactcataacttcctactggagtttggtatacagtgtattatatttacataaaaaaacttttccctacaacagaggtcagcaaacttctgcacactgcctgtttttgtaaataaagttttattgtaacacagtgatgcatctgcactcactgatttatgtgttgcctatgttcattggtttatgtgctgcctgtgctcattggtttatgtactgcctgtgctcattggtttatgtgttgcctgagctcactggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtcttgacccctgttctacaaagtcactggcaaaacatgtataatgaaaaatgcttagtcctgctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaagccacactcactcattgggaggagatgaagaactgttcatatgtcactcacagacatggtcctttctggcaggatctgagactgttttaatagccaatcccttaaccccggattctgatgaaagggaaggctcaagccatccaatcacatgtcattgctagtcacttacttctcatcttctccttggctccagcaatcatgtagtaaaagatgtggaatgtcctctcgtctctggcttggcgaattgcccgtgatttttctagcagatctggtttggagggagttagggattctggggatactgcgggtgttcctctggtcttccacctccatccctgtcacacccaattcacatgggatgactttccagttctacccctgggatcggtaatgtctaactttgaccattgcccctatggacaaatggaaccgctgggtgctgccagcagacttcagatgcaaaaaaaagggaggggaatagagtgaaaagaaaaagcataaaaaggctccaggaagaaggtaatggtaacgagatgttcccctaacagccatcaccagcaaatcttctttaaaatgagctgtcttcagacatgacagaatacaaataatgacaccatctatgatcctatgatttatgattcattcctgtgtgaaatgattgatataaattgtctcactgaagcctcacaaagtatgctaggaaataagtgcaactattatcggtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggagagggcagctgggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgcaacctctgcctcccggatccaagcaattctcctgcctcagcctcctgagtagctgggactacaggtgcatgccaccacgcctggataatttttgtatttttagtagagacagggtttcaccatattggccaggtggtctcgaactcctgacctcaagtggtctgcccgcctcggcctcccaaagtgctggaattacaggcgtgaaccaccgtgcctggctgagatgtgtgtttctaaagagctcccaagtgatgctgatgctgctggtttggaaacatactttgagaaccactgatctaaaaggaaggctgaggccagaaggacggggctatgcctggggctcgctctaaacacaggaaatgaattgctgagaggtgtgtgcagggctgcaggacaagagggccctggctctggacttgaccgaagcctgacagccctcctagctgcaggatgggaatcctggctggtttgggcagattaaagtagaaacgtagaaaacattgagttaacgcaatagccaccacctatgagatgctcactttgggcccagtaccgtaccaagggctgtgcatattattatgcatattatttcatttaacccctgcaccagctccagaaactaggtgcaatcacccccattttaccgaggcaaaactgaggcccagagagcttcagtgattttcccaaatccccacagcttagacaagtacagtggagaggaagctactccacaacccaccctcttatccagggcacataacgtggaaaaatgggaccactaggtgctgctagaggacctcaggtgcagaaagaagctaagtcaggcccccaggtcctatacattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcaggtaccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatgacctcaccctcccaagcagctaggactacaggcatgcaccaccatatctggctaatttttaaatttttttttgtagagataggatctcactgtgttgtccaggttggcctcagactgctgcactcaagcaatcctcccacctcagcctcccaaagtgctgggattacaggagtaaactaccacacccagcccactatccccattttaaagctgggaaaactaaggctaaaagagatcaagtgacttgtccaacgtgacgttgctcctgagaggtagggccctaagcagaaagaaggtttttccatattcaggggctagagggctccctccccagaccccaccctgctccaaaacatccacatcatccaactatggattaaaccttttctgtgggacaggtgagtatgcattggccacactgcccaagcaggccctgtgtaggatgtcctttaggcaggaatggctcatgttcctggccctagaggctcaacaagtatctccaaagatggccctatctacctgcctcagctaagccatgaaaccaaggatggaacccaatcctccatctgttggcatgaacccttttcctgtttcctcaacaggtgagacaggatttcatccttttcccccatcatgacataacatggtgggaagtgttggcgtgtgtggacacaatcccctaggcttgctcagtccttgacaaaaccttcaaactttccccattgggaaacatgcagtagagtgatttgggatgaccatatcccagatggagccagggagagccggctggtcacaggcaaggcccaggcaccttcttcactctccttcccaagatggcagggacgccagtgagtggaggatgtttttagggatttgtcttgcacgtgcttccatttatgacaggctagaaacattgcacagaattggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgcttttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctgtgcctggtctagatttttatgcttttaaatgaaagcattaacaagtgtttaaaatgttgttctaatacaagaatatcccatctgtgtgactctagagaagattgttctttggttcagcgcttcactgagagtcagttgccattctggaaaatcccatgccaacatcatcagtgcctgaacttgacccttttccttgtatttgtagctgtcgccgtggatagacctaagtgtctgtctcttactgtgtcttctgttggtgtggcctggcccgagcattgatatgctgaaatgcactttatttatttatttttgtagagatggggtttccccatgttgcccaggctggtctcaaactcttgagctcaagtgatctgcccgcctcagtctcccaaagtactgggactacgggcatgagccacctcgcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcctggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaatatttgttgagtgaatagtgaataaattaatgaatgaatgagagagtgagaggcaggagcccttgcaagattgtgagatacagcccatctctccagggtcagatgcccctcccacctctgcacgcaaacactctgcagccccaggcaggagatgacaccaaagcttttctggaaaatccatgtggctttgctacttacgaatcgtgaggagttgtcgttcttcactgttttggcgttgccgaaagcctccagaatcgggtttgcttgtagaagctgcttttccagctctccctaaaattcattcacatctagttattggagaaagcaacctaggtcctgacagttctaccttggatggatgttgtcacaaaactctgcccttaacccacaggttctctcctatctcctacctcctcttagaccctgatgctaatgttcagatttacaggaggatttcagaagagaagcaactgtctgagctctctaatagctaggacatctgctccctaggaaggtcacttttttcaagaccagggcctgctcatctgtgcaacatcactgccactcaaagccactgccttgcacaatgtcggtgatgtcatttacatcatgatgaatggtgccccccggagttgtgcagtgcaccacctgtcccactgtacatggcagtcgtgctgctgttcatgtttaacaagcagccttcttcaagttaaaccactacaagcctccttctaattattttagtgcaattttttttaagttgcaattttttctttctcaggactggttttctgaagtcttctacagcagacaagtaaggaatgcacaaaacccaccaggaatcctcttagcggactgcggaataaagcttcaaagcaggttgcctgagctccattcattgggttaaaggaagctgagactgtacacagcccaccggccccctctgccgggatgcctttgcacaaacgcggtcacgtgattaatcatggcaggaaagggccaatgtggtaagttaagctgggaaagcaaacgagctgctcttggcctagccctaaaacatggcggctgcagttgggccccgaggcctccaggccctggattctgggagtttttctccttgtcctcccctcctgctttcccttccttatttttccaggcatcagggctgggctggacaggagccgggaaagtgtctagaggggacaaggatgggcatggcttcctcctcattcctccgcatgctaggaaggcatcagggtacctggtctacaggacaaagcaggaagctgctatttgtttctgttttgatttgtccacacatcctcctttttgtagctcccagagaaagatgaagcaaaagcctcatccgcatacaaatctcagctacaagtggaatcaccacagctgagactggtggaaatttacaaggagcaccacgggcatttctttgttggtgggaagacgactaaaggaatcacttttgttcacataaacttggggtctccatgctctctgaaaaaggctccctttctagaatggggattctggcaggtaaggttgaaaagtcttggcaagagagctttaaatcgggggacctggttcaaaccctcaattttatagatgatgaaaccatagccccgaggagttaactgactcggccaaggtcacacaaaagcagatcccaaataagaactgtaattctccttctgatctgcaacacagtcacccagggtctaactaagatggattgaatgatcttttcgggagccaaggaagacacctgtgggtttcttctaggctgggacccacacatcagccccccaagctctgtgttagagatgagtttacatatgcacaggtccaagcaggaccaggttatgcgttgcgtagctggggccttaccgcgccaccaaagctagtgcatcgcgacctccaagactgtttctggaggcttgagtcaagcaaccagcatgcaagagacagacacgcactgcacacgcatgcacagggacacactggtgcaccagggacagggctgagggaagacacttagggatgatggcagggagagaagagggaggcatgccacagctgtgccatcgactgtccatcgagccagggaagctttggggcctgacagtcctaaaacactcagccagatgggacagacatctctgtctaggttgttccagtcaagggtaccaggagcggatgctttgaagggtgcaggggttcattctgaaccggagaaatccatttcaggctggagcgcaaccctggggactccaataggcgtcccgtgggtggtaaatgcacccccacacccttccctggcatcagacacccacaggatggtattttggtgcatttactgatttaagttgtgaaactctagggcctaccccatttctaccaccagctacgggactcggtgggtgcaagaggatcatgcagatctaagttcactccgtgcctcccctacacaccaggaaaacactctcagttactcacgtaggcaaaagatgggccttgctgtggttgaacaacacagtataaaacaaatgtcagcgttatttccatcacatggacatcaggggctggagaatatatgactttgatccccccaaacagcctggagtctcccagacagactggtcagctccttttccttgatactgtttcttttctctctgtttagctgcaggaatacgatcacagctcactgcagtctcaacctactgggctcaggcaatcctcctgcctcagcctcccaagtagctaagactacaggcatgcacaccaggcccagctaattctcttgatttttttttttttttttttttggtacagacagggtctcactatgtcacccaggctggtcctgaactcctgggctcagaccatcctcccaccttggcctcccaaaacacagattacaggcatgagcccccatgctcagccattccctcctttttctaatttcttagagatccagacatttcaaaggttttcataattactggggccacattaggctccttaaaacagtatccagtgagacaatgtctgagatgtgtttacgcatgcagccaaaacaagcagcacatagtaggcccttgataacgatgagttgttagaaagtattatctcctgtgtttactctttagggaaagggaaggcagtggaaactgtgtttaaactgccacacagcctctggggccattgttcccactcactatggctggaaaccaacttgccagagacaattctaggatgctgaatcttgagtttcctgcatttgtttggagaaggaaagttctccaaagccacgaccagcgcccatcctagatctccaagggcctccagacaagccggccatggtggctgccccagagtcccctctgaggacgcaaagtgacatctggaatggcgaacactggagacaccccatgccgtggtcagatctccatcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtctggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatatttttggttgtcacaactggagggaagggggctgtcggcatctggcgggtcgaggccagggatgttgtgaaacattctacgagccacagggaagcccctccaaggaagagttatctggtccaaaatgacatcagtgccaccactgagaagccccgacgtggaggaagatctcgctatggaaggaaagggcttattctcatttcacaaaacgggcccccttctggagggatgcttctagctgagccaagaaatcacccacactcaacaggcctgctcgccaaaaagacggtccctctttgagtcttcaggggaggggtagtcagatggggcctgagttcttgcaatgatgttctgtttgtatctcggttgggctgcaagctggagaccggttggctaaatcatggcctctgattgggaactgccactcaccgtgatacttgtgtctttcttgcccttgtgggaggaggccaccacggccaggtactgaatgaccttcttggtgttttcggttttcccggctccagactcgcctctgaaagacacgggaacatcatctatgcacacgttccatggtgacctttccgcagttccatgagccaggcaggacaataatgatcatcaccaccatttcccagagggtgaaacagaggctcccagaggggaagtaacttgcccaaggccacatctctggtagtgagcggaactgggtccccagcctaggtccaatgcccaatctattccttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaagttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttggaattatctacttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctggctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatcttttttttttttttttttaccaagatggctttcgtgcactagctgcctgttttggccaccagaaatcatcacaatggaaccgctccatccagatactgcctctatgttccaccactcctagtgaaagataaggacagtgccttgaccaaaacttcacttgtttatcgtcttcttctatttttcagtttacttttgttttttgtgtttcctttctttgccttatctcttttattttctgagctcacttaatactctaaaatataagagagttttttttttaagttgaaaaaagaatttgttcaccccgaggtcagcccaaggttctctgtgctgaaccagtgccaccaaagctagtacagtctctgctcttcttcctaattaggaaataaagaaattaattttctctgccaaaggcccattaataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgagagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcattcacacctaagtatgaattacttcaatcaggctaacgtcagaaccttgcttgacttcattctaaagtgaaggggttggattctgattaaagcaagagaaaggagagaaatttttggatgtaggaaaccacttgcgtaggtggtcatgaacctattcagatccaagacaagaatcaggacagcagtgtgcacaaacaacatgtgtggatcacactcttcatgctgacaaaccagtgctcctagactgctgctgctcacttctcctttcccacaatagttccttcctttccaccctggccttgaacctctctcacctcctcccttttacaacaaagacatcaccgggtgtggtggctcacgcctgtcatcccggtactttgggaggctgaggcgggtggatcacttgaggtcaggagttcaagaccagcctggccaacatggtgaaaccctgtctctactaaaaatacaaaaagtagctgggcatggtggtgggtgcctgtagtcccagctacttggggagctgaggcaggagaatcccttgaacccaggaggcggagattacagtgagctgagctcgtgccactgcactccagcctgggcaatagaatgagactccatctcaaaaaacaaacaaacaaacaaacaaacagacagacaaaaaaaaaaacaaagacatcaatgtgccctatccgtggctatggtctcccactttgcctgggatggggagtgggacataaactctgggcatctaccccttcccatgttgctgctgggctccactgtttccaagttctgttgagaaaaataaattgccctgggaggttctgccaaagaaaacatcccaagctccaggctcgtgggcgtctgaaggttgatgtgcttagagctggttctagaaacattcatagcttggcttttctgacccctgacctctaggggtgaagatgccttcctggtctgagcaccctaaactcctttcttatttcttggggaatttggtactgagctccctcttcccggagaaggaccagactcatgaccacgttatggcctcctggccttgtaactaccccagtgccaagtccttttaatcagtccagccccagcagctgggaagaaccacccaatggccacttaatcccccagccaggctggcttcatgagtgtgacctgtaccgtctcacagggaccaccctgtgcttcatactctaatgttgccatctggaaattcttcctaattctttataaacgctctgcattttttttcttttctttttttttttttttttttgagactgactcttgctctattgcccaggctggagtgcagtgtgtgatggcggctcactgcaacctctacctcccaggttcaagtgattctcctgcctcaacctcccaagtagctggaactacaggtgcccgccactatgcctgggtaatttttatatttttagtagagatgggatttcaccatgttggcgaggctggcctcgaactcctgacctcatgtgatctgcccgcctcagcctcccaaagtgctgggattccaggtgtgagtcactgcactcagccagcattttcattttgcaaaattctacaaattctgcagctggtcctggctcccagggtcgaatattgccaagtccattgcagcctgtggtttgccactggtaggaaagccaaattgtctctgatgaacctcacagctattcagtccctggtctttatgtgactggcaaagcaccctggcattttgtactgtacaactcctacacgtcctgcaaaaccccaggcagaagcaacgcctctctcccctatagcatcaattggcagaatagcataatgggctccaggaccaggttgctcaagttcaaatccctcctctgccagttacctgggtgaccttaggcaagtcatttagcctctccatacctcagtttctttaccccattataaaatgggtataataaaaacacttaccttgtatgatttttttttttttttttttgagacaagatctcactctgtggcccaggctggagtgcagtgatgcaatcatagctcactgcagctgagaattcctaggctcaagtgatactcctgccccaatctcccaggtagctgggactacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcaggccggagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagttatatattgtttgtataatgattttcagcattcatcctatcattacaatataaataatattcacattttcccactgtttaagctaggagttagcaaactctttttgtaaaaggtcagacagtaaatattttagactttgagggtcacgcattctttgtcacatctgctcagctctccactgcagcacaaaagcaaatacgtaaacaagtgggtgcggctgtgtttcaataaaactttatctggaacagacagacaagggcctgatttgacccactggttaaactttgtccttccttggcttgagtcccttagcacgttctcatccatttcatttatttattttattgttatatatattttttgagatggggtctcactgtgtcacccaggctgaagtgcagtggtgcagtcttggctcagtgccaactttctgcctcccaggctcagtgaaccgagatcctcctgcctcatcctcctaagtagctgggactacaggcacatgccatcacgctcagctaatttttgtttttgtagagagggggtttggccatgttggccaggctggtcttgaactcctgagctcaagcgatcagcctgccttggcctcccgaagtgctaggattacaggcatgagccaccatgcccagcctgtcatccattttagacgaaagtttaaactcctccccagggcctggaagcacccccttacctctctctaattttatgtgaaaccaccctcctcctcttactttagccccctgatcacacagctctatctccagccaggcccatggcctctaattaaactgattatactggatggattacatgctagacaaaatacaactcaggcctaaaaattacatttattcagctttcagtttccttcctttcttgtcttccttcccttcctttccttccttcctgtctctgggtcttgctctgttgcccaggctgaggtgcagtggtgccatcatagctcacttagcctctaactcccaagctcaagtgatcctccctccccaacctcctgagtagctgggactacaggcatgcaccatcccacctagctaatttttaaattttttgtagtaatggggtcttactgtgttcctcagtttggtctcaaacttctggcttccagccaccctcccgcctcggcctctcaaggccctgagtttccaggcataagccaccacacccagccaattttcagtttcttttcttttcttttttttttttttttttttttgagacagagtctcgctctgtcacccaggctggagtgcactggcgtgatctcagctcactgcaagctccgccccccaggttcacgccattctcctgcctcagcctcctgaatagctgggactacaggcacccgccaccatgcccggctaatttttttgtattttttttagtagagatggggtttcaccgtgttagccaggatggtctcgaactcctgacctcgtgatccacccgcctcggcctcccaaagtgctgggattacaggcgtgagccacggtgcgtggccaattttcagtttcttttcttttcttttttttttttttttgagacagagtctcgctctgtcacccaggctggagtgcagtggtgcgatctctgctaactgcaagccccgccccccaggttcacaccattctcctgcctcagcctcctgaatagctgggactacaggcacccgccaccatgcccagctaatttttttgtatttttttagtagagatggggtttcaccgtgttagccaggatggtctcgaactcctgacctcgtgatccgcccgcctcggcctcccaaagtgctgggattacaggcctgagccacagtgcgcggccaattttcagtttcttaactgcataaccaaacagttggctccagcctggcttctcttaagcaccaactacgcgtaaaagctcagccctgctgtcaacttgtaggtccttcaagtcactttggctgaatttcacaacaagcaaaataaaattgaatacagagactgaagatgttggtggttctgggctgactggatgcatttgcaaataaaagtctgatcgttttgggatttccttcctaacaatggctaaggcctccttctccagcactggctgtgtgtgggcagtgtgccaagtccttgctaacgctgcattccaggagatggagatacacaatagccaagtaaacaaataatcaagatagttcgtggtggagatatcattgctacatctgggtgatgtgactgagaagatcgaggggaagggaggagaggggaggctgtggatggggaagccagggagttgctgagccttgaaagttacaagagagccctgtgggaaggatggagggaagggtgggccaggcagggcaaacagtatggacagaggtccaagggagggaaatgctgggcccaggtatgagacagaatggctcccagcatggctggagggccacaacagaggaggacagcaggaagtgaagagggaagagcagatcacactcagtcttccaagtcacagtaaggaatctgagttttattctcatgggtgcaggaaaccatttcacgaggggaacgggactttagaaccagtgtggggagaatcagaactgcaggatgggctgggcgaagtggctcatgcctgtaatcccagcactttgggaggctgactgaggtgggtggatcacctgagatcaggagtttgagaccaggctggccaacatggagaaaacccatctctattaacaatacaaaaattagctgggcatgatggcataatactcgggaagctgaggcaggagaattgcttgaacccaggaggcgggggttgcagtgagccaagatcgcaccactgcactccagcctgggcaacagagtgagactctgtctcaacaaaaaaatcaacaacaacaacaaactgcaggatgggccaggctcagcggctcatgcctgtaatcccagcacttgggaggccgaggctccccgggtcacctgaggtcaggagttcgagaccagcctgaccaacatgacaaaaccctgtctctactaaaaatacaaaattagccaggcatggtggtacatgcctgttatcccagctactcgggaggctgaggcaggagaatcacttgaacctgggaggtggaggttgctgtgagccaagatcacgccattgcactctagcctgggcaatgagagcaaaactccatctcaaaaacaaacaaacaaacaaacaaacaaactgcaagatggatactggattgcaggaaggatttttaaaaaatagtgagcactttcactacaatagcagctgatccttacaaagtgctcaccatggggcagtggcctgtttctcagttcttcacatgtagtgactcatttcatccttccaacaacccaatggggtgcttattgttcccattttacagatggggaaactgaggctcagagaagtgaactgacttatttcctggagcatacaactaactagacgatgatggggccagaattcaaacccaaggggttaggttctggaatccacactttatgacagcatgctaatgaatatttattcaatgaataatgagtgaatattcttataatgtatatttattaaaggaaggaagcaagcaagcaatgggagcagggagcttaagagactgctacagaggccctggtgagaggtgacgggaccctgaactaggaagaggcggtggagtcagaggaatggacagagatgagaaatatttcagcatcataccgtccaaggcaggaaccgctatctaaattaactaaaatcttaaaaattcagttctgcaatatacttgccactttttaagagctcaattaagtgaacttttaagtgaactttgtgctcatcacaaagttcttttggatagcaccgttttagatgaaacagcacctgctgatggcatgggtgctggaaatgagagcagggtggcctcttcttcatcttcacagcctctccataagctcagctcagagaggtcaagtgacccgtgcatagctacatagctaggaagccatctgaaagtcctactctttcctgcacctctctgttaccacacttaattcattcactcaacagagggcagttgagctacactattttggttcctggggagatgacatgtggctcacacatgggtttggctcctaggggatcaaatgcctctgtggctagctgaaaaacagcccccacaagaatgtccatggcctatcctcagaatctgtgaatatgtttgcttgagatgaggagactgtcttggatcatctaggtggggctaatataaccacaaaggtactgggccttataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattcattgtcaaacatcaaatgtgtacatcctaccatggaatatgagaattcagttcccatctaatcctcttccctttccccacagagccaagtccatcacagggagttattctggttagataaatactccaaacttgcacagctgggctccttagtccaatgtgattacttctccttccatcccaacttttgttttttcctggagtttataattgcctttgttttattgtttccaggttttctatctatatcaaccccaaacttattaattgtttcaatcttctctcaatacagttcattgccatcctaccatccatcaccatctgaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagtgccacctttttttgtatttttgtggctttttgttagttattttgcagtttaaaatgtcccctcagatgtgctcccttcggcagcacacatacaaaaatgtccccagcatagtgctcaagtgttggctcatgtttccaagcacaataaagttgtgatacccattatgtaataaatacacatcagataaacttcatccaggcatcagccacagagctgctggctgtgagttcaatgtcaatgaatcaacaatatatattaatatatgttacttgcatataaatacaatagtgaaaactctctcaatgattctaaaattgagttactatcttctgcctatgtacctaggtcttcaaagaaacagtgataccaatcaccaaatatggcactgatgtgtttgtggcttgataaatgtgaaatactaaagtgacagtttaacatcttccctatcaacacagatggctgttatgcaattagataagattctgcatataaaatctttagttcaagtcctggcacagagtacatgttcaataaatgctagttttttagaaggaggagaggtatggaaccaaatgatagcaggtgtcattaagagtttaagtttgcctgcctccgcagaagaccatatatcacaaatgtttagtgagcatctacatggtgccaggtataaagagaggcacttggaaccatgaacaaatcaaagatctctgcactcatggatcttttctttcataggttggatctcgactacagattaaaaaaaaaaaaaaacaaaaaaaaaacagaagaaaaagcagttccacttacgtgcatagaatggactggtcctcccgatctgcaaacagaaagaagaaaaaagagccatgaattaaaatgagctctgagctaagggtctggacttggctcctcccagggccctcccattctaaagcttctccatgctggcctcattggaagtgacaacaggtcagctgggctcattgcccaggctacaggggccacgaccaaagccaaaagggcagccccaaagtcccagaggcagccccagaaagatgctggagcctgactgatccaggagtcattagcatccagccacatcagctctggaggtgtcccgggaggcccaccccacccagattaggttagggaccaaacgcagatgttggatctatacagattggggtcccccttagccacttctccgctctgtggccttgggcaaatattcttaaactccatgcctcagttccttcatctgtaatatagtattgtgcacatttgtgtttttttgtaaatccagcatccatttcctcttcttccagaagcatcctgtggtccttgaggtttcccccatcacccctaccgtcatgtacagtcttagtgggactgcctcataagtaccttcaacaaagaggtaagaatgtgttccaggctgcattggtcagactctctggcctaaaactccaagctcagtcaaggacagggaagcacagcaggtggacagagccctgaggcagacttcctttctgcccctgggcccaagcagcccagtttctgtcatttacctagcctgattcctagtgttcccactgcaactgtgagctcctccatactcccctacaaatccctttcctctactagatgacagagtcagtctctcttgtttaccaccagagaaacccaaaagatacagaggtcatcaaagaactagatgtgattaagcagacattatccatcaccttctactcttaaagaggcctctgaggtggagccaggctctgaagacccatttccttcccaaagagagatctgagaacagttaccaatacgttcaatggtcacctaacaatgtagaaatcccagcatcatatctgctggtagacaatgccacagtggcaagcatttcttaaatccactccctggcttcagtcctactagttcagtgctcagctctcacaagcttcatttcatcaaaaatctcctaggcttggttttacattgtatctctagtactggcacatagatggtaggtgctgaattatgcttgttagatggatggattgagggatggatgagtagatggatgggaagatgagtggacggaaggaaggaagaaaggaaggaagggtagatgggtgaatggaagggtgggtagatgggtaggtagatggatgggtgggtgggtggatgaatagacagatggacgggagggtggataagcagatgagtaggtgagtaggtgggtgggtggatgggcagatgggtgggaaaatggatggatagatgagtagatggatgggaggatggaagaagaggtggatgggcaagtgagtggaaggaaggaagaaaggaaagaaggaaggaagaaaggatgggtggatggaagaatggatggataggtaaatggacgggaggataaatggatgggaggctgggtgaataggcagacagatggctggatggaaggatggatagatggacaggtagagagacaggaagacaaatggatgagtgggtgggtgggtaggtggacgaatagatggatggaaagaaggaaggatggatggatagataggaagaaagaaagaagaaaggagggaagggtgtgtagatgggtagatgggtgggtatatagctggttggacggatggttggacggaggagggaaggatgagtgagtggatgagagagtggatgggtgggtgaatgggagggaggacagagtgtataggccggtaaatgagttggatggatggatggatggatggatggatggatggatggatggatgggaatatgaatgggaggatggatgggactgaagaaggcaaggtgaaagagatgactctttcttccatctgtaatcttaagagagaactgattggatgtgggcacgttcctcagattctatgcccaactccaatcagttctctctctcttccctcggattatagatggatgtttgggtggcctggttgaacgaaatcctcaagacaaaaggcctaaagactagtcagctctggggtttcaattctggtgtgtttatataatggcacatttaaaaataggcaggccgggcgcagtggctcatgcctgtaatctcaccactttgggaggccaaggagggtggatcacttgagttcaggagttccagaccagcctggctaacatggtgaaaccccatctccactaaaaatacaaaaattagttgggtgtcatggcacacgcttgtaatcccagctactcagaaggctgaggcaggaaaattgcttgaactcaggaggcggacgttgcagtgagccgagatcgtgccactgcatgccaggctgggcaacagagcaagactctgtttcaaaaacaaataagatataaatacataaataaaataggcagccattgaaaagaaccaggcagagctttgtggatggacacagaaaaatatccaaaatatattaagctaaaaataaaagatgaggtagcatagtgttataccttttgtgttttaaaaagacagatatataggtaggatgcagtggttcatgcctgtaatctcaacactttgggaggctgagatgggaggatcacttgaggccaggagttccagaccagcctggacaacatagcaagacccagtctctacaaaaaaaaatttttttttaattagctatgtgtgatagacataccccttgtcccagctacttgggaggctgagacagtaggatcccttgagccaaggagttcaaggttgcagtgagctgtgattacaccactgcactccagcctgggcaatggagtgagaccctatctctaaaaacagacctgggatgggtgcggtggctcacacttgtaatcccagcacttcggaaggctgaggcgggcagatcacttgaggtcaggagttcaagaccagcctggccaacatggtgaaacgctgtctctactaaaaatacaaaaattagctgggcatggtagcatgcacctgtaatccaaggtactccggaggctgaggcaggagaatcacttcaacccaggaggtggaggttgcagtgaggtgagatcatgccactacactccagcctgggcaacagagcgagactccaaaaacaaaacaaaacaaacaaaaaaaaccaacaaacaggcctgagcctgaagtattgagaaaagggacaggaggaagacctactttcacccattctacttctatcctggttatgtttgtgctatgaacacatacaatcttttcctcatcccaccaaaaatggtcaatagaaaaagagtcggtattgttctttatgaaaccatcatgaccacaaagctaaaaaaagacagaaaagaaagagccaccgcattaggatcccactaacagctccgatctcccgagcactcactgcactgcaggcgtatgctgaacttctgtgttgaagtgacccactgaattctctcagcagctcctggggtgggcactggcattgcctccattttacaaataaggagagtgaggttcagaagtgaggcaacttgcccaaggtcactagggtgggttgaactgtgactcccaaaagctatgttcactcagaacctcagactgcgatgttattgactaaccaattgattgagatggggtctcactttgtcgcccaggtgggtgtacagtggcgtgatctcagctcactgcaacctcaacctcccaggctcaagcaatcctccctcttcggcctcccctgtagctgggactataggcacatgccagcatgcccggctaatttttgtattttttgtagagattgggtcttgctatgttgcccaggctggtttcacactcttgggctcaagtgacccacctgcctcagcctcccaaagtgctgggattacaggcgtgagccactgtatcccacctgtgattttatttagaataagggtcttgcagatgtaattaagggaaggatgttgagatgaggtcatcctggcttggagtgagacctaaatcaatggtgtccctatttataagagaaaggaggccgggcgtggtggctcacacctgtaatcccagcacgtgggtggatcacctgaggtcaggagttcgagaccagcctgggcaacatggtgaaacccatctctactaaaaatacaaaaaattagccaggcatggcggcaggcacctgtagtcccagctactcgggaggctaaggcaggagaatcacttgaacccaggaggtggaggttgcagtgagttgagattttgccactgcactccagcctgggcaacagagcaagaccccatctcaaagaaaaaaaaagcaggaaaaaagcaatcaaactttaatctctccattatactctggagacagacagatacccgtgcctttagcttccacccagggggagaaattcactcgaggacagagcaaaatgggaaaccagtttaattttttttttttttctgaaatggagtctcgctctgtcacccaggctggagtgcagtggctcgatcttggctcactgcaacctctgcctcctggtttcaagcaattcttccacctcggccccccgagtagctgggactacaggtgcgtgccaccacgcctggctaatttttctattttttgtagagacggggtttcaccatgttggccaggctggtctcgaactcctgacctcaggtgatccgcccgcctcagcctcccaaagtactaaaaagtgattttttaaaagagggtgaaggatagaagaaccaggtaccctgtgattagaacccagacagagagaacctcctgggaccggcccagacaacctccactatcttaaggaaagattttgagatggacagacagatgggctgtgttgatccactacttcagggagagaggcaggctttcctggcagccttgtgaatcctaggcccagagcaggagagatttataggctcagatgctcacagggcccccaggagagggagcgggctccaggagaaggcctgggagctgccagcgcggctccgagctgggggctgctgggagacctctggcctgacgttcccatcaaaaacacaccacttccaggcgtgggaagcttgcagggtgctggttacgagcagaaggactccatgtgggtgctgtctgccaacccgtgtggagcacagggaactctgagatcctggaaatttttatctgattccttccccaagcctgagcttgtgttggactcaaaagcagtgttctccaccgtacaaagcagtttcactccctccttgctttgcacaagtgatttcttctgcccagtgcacccaccaccacttcttctctggcctaatccattctctctctctctctcttttttccttccattgaggtaaaatttacactacataaaaagaaccattttaaagtgaataattcaagccaggtgcggtggcttatgcctgtaatcccagcactttgggaggccgacacagctggatctcctaaagtcgggagtttgagaccaacacggcaaaaccccgtctctaccaaaaatacaaaaattagctgggcgcggtggtgcacacctgtaatcccagctactcaggaggctgaggcaggagaatcgcgtgaaccagggaggtggagtttgcagtgagctgagatcgcgccactgcactccagcctgggtgacagagggagactccatctcaaaaaatagtaataaagataaaaaaataactaaagtgcataattcaggagcatttagtacattcacaatgttacgtaactaccacctttatctagttctaaaatattctgtcacccccaaatgaaaccctctacccgttaagcagccactcccccataagcccttgcaaccgccaatttgctttctgtctctatggtcttacctattctagatatttttgcataaatggaattataacatgtgcggcctttcatgtctgacttctttcactcagcatgtggctgaagttcatccatgttgtagcaggtcccagactttatgcctatttgtggctgagtcatatcacattgtacggatggatcatattttgtttatccattcaacagttgacggacatttgggttatttccaccttttggctattctgcatagtgctgctatgaacattcctgtacaagttttagtttgagtaccttttcaattcttcgggtacataccctaatctgtatctgaaacatcgtcttgggagtcaactcttctatgataccttctctaactctgcacttttctagagctgagttggagacctttccacttgacctcctacctgcaggatggccatggaccgtggtgcatgttgtacactgcataactctatggagaaactatttgcattggtcatttattgtattgcattgtgtatttattgtaataatctttcagcagatggaggaaaagtgctttgagaaaacggtgcctttctctaatataaacatgagtgtcacatggcctagtggttcccatggtccacaggttctctccattttagtaattatcatcattgtgatccttacttaataaatgtctcaaaacattctggcggaaaaaggtacagatgatatggaatgataataggccatctatccatgatatggcattcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaatgcaaacattagctgggcatagtggcacaatccctgtggtctcagctactcaagaggctgaggtgggacaatggcttgagcccaggaggtggaggttgtagtaagccacgactgcaccacggtactccagctggggtgacagagacagaccctgtcttaaaaaatatataaatagtatgaatccatgatacaacgtggatgaaccttgacaacattatactaagtgaaagaagctagccggctgggcacggtggctcacacctgtaatcccagcactttgggaggctgaggtgggcagatcacgaggtcaggagttcaagaccagcctggccaatacagtgaaaccccgtctctactaaaaatacaaaaattagccaggtgtggtggcacgtgcctatagtcccagctactcgggaggctgaggcaggagaatcacttgaacccaggaggcagagtttgtggtgagccgagaccacatcactgcactccagcccgggcgagtgcagtgagacactctgtctcaaaaaaaaaaaaaaaaaaaaaaaaaaaaaaaaaaaagaagccagccacaaaaggtcacatatgattccatttatatgaaatgtccagaataggcaaatccatagagacagaaagtagatttgtgaattcgtggctgccaggagctgcgggtaggaatatggagtgacaaaaaaatgtgcacaagatttctttgggggatgatagaaatataaaattatattgcagcaatggctgcataaccatgtaaattatgagtgaatttagacagttatgcagacatagctgcaattttaggtgtgaactgtatccttaaaatgaatttatttaaattataccgcataaaccttttttaaaaatgatgttcattttataccacctctgaatgattataaatctgacttcttccacttcatgcagctctattaggtttccaacaattacaaaattgttcattttcaatgcttttcccctgaaccaatgagctcctgaaggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgcttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactacgcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatcacaggctcaagccaatgcaccgagcttcatgacttgcttatccttgcttttgagaagttcatgacccagggtgggagtcagatgggcaaagaaatgaccgtaagagatgagcagtgctacgatggatgtgaacccaagtgctatagacgtcaggttttttgtttgtttgttttttcacactgacctgagcaagacaggaagccttcacggcagaggtgaccactgaacagcattaagaaaaatgtgaaagaatctcctggggagaggtcgaggcagagcatcccaagcagagggcctgggacagaagctccaaagtgggcggggacacagtaccgagcctccgtggagtctgggaaggctggagctgggggcggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatggcccttgacggtgggtcctcggcagctgactgctaatgcctgttgaacttgtcctgtccatgcaccgtgtccctacacactgaccgaatcacccttgtaacaactggagtaagcacagtcatcatcctcacgggacaagtgaggaaactgaggcacaaagtaatagccggggcagagctgggaggtgaacccagctccagagcccatgacctaagccattctgtaagtgagggcccttctctttctccagccttcatctccccactctactctcccggcagagttggttaggatgacatgctgagtaagaagagatactttgagagcctttgctgcaacccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaaattttttttaattagctgtggacagaggtgtgtgcctgtagccccagctatttggaaggctgaggcaggaaaattgcttgagcctaggagttcgaggttacagggagctattattgtgccactgcgctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagcagcctcatagaacctatatcaagttccctagccaagcctacacttcaccttccaaggaagcctcccctgtcctcccaaggtccccagggctacacttccccactctctggacctcctctacttagcagctacttgtgggatgattcaattcgtatttacacatacgcacagtaggctgtgtctagggcaacatctaataatcaatattgttagaatgaccgggcgtggtggatcacatctgtaattccagcactttgggagaccgaggcgggaggattgcttgaggccaggagttcgagaccagcctgggcaacataatgagacctcatctctacaaaaaatcaaaaaattagccaggcgtgatgatctgtgcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacgcctataatcccagcactttgggaggccgaggtaggtggattgcttgggctcaggagttcaaggccagcctgaacaacatagcaaaacctcatctctacaaaaaatacaaaaattagccagttgtactggtgcatgcctgtatgcagctactctggaggctgaggtgggaggatcacctgagcctggagaggctgaggctcaggtgagccgagatcacaccactacactccagcctgggcaacagagtgagactctgtctcaaaaaagcccaaaacaaacaaggaaggtgttgccaagtgtcagctggggcttttcaggttcactcccttaagtatgtccctttttcaatttaatatttacggtttttgtttttgtttttgtttttttttgagacggagttttgctcttgttgcccaggctggagtgcagtggggcaatctcggctcactgcaacctctacctcccaggttcaagcgattctcctgcctcagcctcccgagtagctgggattatagtcgcccaccaccatgcctggctaattttttgtatttttagtagagatggggtttcactacattggccaggctggtctcgaactcctgacctcagatgatctgcctgcctctgcctcccaaagtgctgagattacaggtgtgaaccactgtgcctggccaatatttactattttataacaaataattctcctttgctgtctcccttccctgtaatgcaccatgggtaccaaaaataaaaataaaataaagataaaaacgtgaacttttcatgattagtcagagcaccaaacagacactcctagcacctctgtaaagactgagccagccagacagagccattcattcccacacacagtcccccatcattcccaaccgggccagacacatagctgacagccactgcaaaacccacaagagacagagaagcatttggctgtaccccttcctggagatgtgtttgtagcagcactgcctctgcagagaaacagctgggaattacttcttggctccaccctatcacctctgcccccagggcccgtttcctcaccagggaaatcgacaaaaatccagacctttcaagggcatgaagatgattgaaagagactggattcagaaagagcttaaaattgttttacccacagcacatttaagagcttggtaattgccgttaatatcatctttatcatcatcatctaaaacagtgatctagggaagaggttatagacagcagtgattctgaatcggcaggacaggatattcaaccaaagatatttaacccctttctgattacaaggtgtcatggtctgaatgctcatgtctccctcaaattcatatgctggaatccttacccctaaagtgatgatattaggaggtggggcctttgggaggtgatgagatcatgggggttcaatcctcattgggggagagacccagagagctagcaggtcccttccaccatgtgagacacagcgagaaggcagcactaggccctcaccagataccaagcttgatcttggacttcccagcctccagaaccacgagaaacaaatatctgtttaaaagccacccagtctatggtattttgatatagcagccttaacaggctaagacacaaggcctatgctagtcccttagccttctgggggcctcagtttcctcttccgttatatggggacaagaatactacactatctataccacgctacccaggagggaagagtaacattctgagggcagcgaagctgggtccccaggtttgactctcagttctggggccaagtaggtgtgctgagttttccccattgatcaaatggggaggctgccacccaccctgtgtggtgctagtgagggccgagcaatgtgggattgatggagcagtgaacccaggtcctgacctattgcaggggccctgaggacatcagtgcccttcctctctctgcctctactggggagcagcctcaggggagttgggtgagcaggaaccatccccagggggctgccaatctcaagcagaaggatacagccgagtgtgggaacttgcaaagtggagaaagtcgtttggatcactccacccgcagagttgtcttaagcttaaagaggaattagccaagagccccaagctgataaaggctggctgttatttctttttttaatcccctgagtgtggccatttgttgctaatgaggtgaggacaaaacattacttgtggctatcttgcatagggcaagtgcagaggctcagaatggaatcttatctgctttcctgcccctcctacaccccagggacccatggaggggctccaaagtggttcttgtctggagggctttaatggcgcttttctcctattcatcacgttcatttattgaacttagctccagcctcctaagctttgagctgtcaacactctgagatgaagacagtagacagccttccgtgggattgagggggatccctgtggttgcccggtgtcaccgactgaccagcagggctccggctttggagtcaggataatccaagtgtatatttggctctgacacttaacaaatctgcagcaagttctccactcctctgagtctgttttcccagctgtaaaagggagctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtggctcatacccataatcccagcactttgggaggtcaaggcaggaggatcacttgaggccaggaatgagagaccagcctgggcaacacagtaagatcttatctctaaaaaaaaaaaaaaaaaaaaaaaaaaaaaaagttttttcactaggcacagtgggctcacacctgtaatcccagcactttgagaagcctaggcaggtggatcacttgagctcaggagttcaagaccagcctgggcaacatggtgaaatcccgtctccacaaaaaatacaaaaattagccgggtgtggtggtgcatggctgcagtcccagctacttggggagctgaggtgagaagatcactggagcctaggaggtcaagcctgcagtgagccgtgtttgtgccactgcactctagcctgggtgacaaagtgagaacctgtctcaaaaataaaaaagactgggcacggtggctcatgcctgtaatcccagcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcgtgccattgcactccagcctgggtgacaggggtgaaactctgtctcaaaacaaacaaacaaaaaacagttgtttttttttaattagctgagcatggtggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatgcctgcaccttaatagtttcagggcttaattttaaaattcctaatctggtcctgtccaccttgtaggtttgtggtaaagattaactgagaatatttctgtaaagccctgagctttataggaagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaatacaaaaattagccgggtgtggtggcggatgcctgtaatcccagctacttgggaggctgaggcaggagaatcacttgaacccgggaggtggaggttgcagtgagccaagatcatgccattgcactccagcctggacaacgagagtgaaactccatctcaaaaaaaaaaaaaaaaaaaaaaaaaaaaaaaggtaccaagaaaaaagtctaggtgagcagtgaggaaaggtgggaaacgacctaatttcaacaccgaattccccatttctgccccaaacctcagaaactggcaatgccaggggcctctggaagaaaagatcaaggaggagacaaaaacataaggactgggtcaaatataaggcactgttagacccctcccatatcttctacactccctgaagccaagtgactgcccttctcacaccccacagaaggtggtgggtttagtctctggtgagggttaaacagagggtctccgtcctggggggacaccaggaaccatactgaaagaaggaaggtataatgtacaaatttcactgcacattttgaaaccctcagcttcttttcaactagaccctcaaaatgatgctagacaaatctttaacctccaggcagaagatttttctacaaaccttctctgaagaatcagattagcccatgaacaaaagactgaaagacgaaacagaagtgtcctaatggggtagcccagtgctttcatattatagccaagcacatcagcaagcccatcctataagcactgagcttccatcaacaatttggtatcctgtgtactaaagcatccaagatgaatggatagccaagaatcccaagacatctgaagaaatccactaatatgacagacagaagttaaaacaattaggaaaatatgtatcttggaggaaatagactctgcattaaatatcctctgagaaacaggatattgcaaccacagaaaaagaatgtcatatgaaagaaacatttaaaaataaaatagaatttttggaatttaataaaatatataccagaaatttaaaacgcaatggaagggttagggaaaaaagttgaggtaagtgcccagaaaataccattaaaaacattaaagtgatgaaaatgacaaaagaaagagatttaaattataggattggtctaggaattccattatggaaataaaaagacttctaagaaaaagaaacagagaacacagggagaaagacagcatcaatgaaataatttgcaacatttcccagaatttgtggacacacgtttatagattaattgggccactaagtgtccaggataacaaataaaaatggactcatagcaagtcccatcatcctgaataggggtacaaagacagtctaaaagcttctagagaaggaggaaaaacaaaaactggtcatgtacaaaggatcaagaatattcccagccaggaaggtgaatataatcacacacacacacactcacaaacatacacacatacgaatcagattgggtttcatcttctcaaaactgaaactagaaggcaacaacacaaatgccttaaaaagctcaggcaaaaaaagttatttataactttctgaaaacaactttcttgcctgaaattttaaacccaactaaactatcctttaagtgttagagaagcatcaagcctctcagatatggaagttctcaatgcctcaagatcacgtacattctttcttgggaagctactggacaaagtgcttgatttaagcaggagagtaaagcaagaaagaggaagacatgaaaactgggaaacaaggaatccactatgaaagcactaaggggaatttcaaggatggtgaaaaagatcctatatgacagttactagctatagagaaagccagggcagatcagaaggctatagtagagatcacattcaaggagatgatatcaatatgatatccaatacatgtctggacatattaaaaggagattaacacatttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccataattgtctcttgggagggaagctaagggtctaatgcacaagggttgaagggagaagttcaccttttgaatttgtatgtaacatctttccaaaaacaaaccacggccgggcgcagtggctcatgcctgtaatctcagcactttgggaggttgaggcgggcagatcacctgaggtcaggagtttgaaaccagcctggccaacatggcaaaaccccatctctactaaaaatacaaaaattagccaggcatggtggtgtgtgcctgtagtcccagctactcaggaggctgaggcacaagaattgcttgaacccaggagacagaggttgcagtgagcagaaatcataccactgagctgagatcgtgctgctgcactccagcctgggtggcagggcgagactctgcctcaaaaaaaaagggggggagaatttaaaaaataaacatgacataatttatgcatatgcagatataagatacatattttaaatatcagcttctcttcccataccctcaaggggcttggcttccacttgggagggtgccatgttgtgaagtatctcttagaaagtccctcccattttcccaactcctgtgaggcagcaaagggctgagctctggctctgagctccctgccacagtatactagtcaacccctctaaaccagctcctgccacactcatcatacccattctcacccctacatttatgcttttattattcttggctagaaagccatccctgcccccttctctcaccttagcaaaccattcttcgaggcttataaagccccacctctctcaaataacccaccccatccatcctgaccctggtaggttcttttctataaataactctaataattcattgattcaacaaatactgagcagctactatgtgccaggcaccagaaaatgtgctggagatacaatgatgcacatgcaagaaggatggagtttataggtcctcaggaacttactgtctatgtgacacaactgcaatgcttcatcttatattcagtgcatgtgtgttacccatccctcctcaatcccgccttttcacaccccatcttttccatgaagaactcaaggaagaagccacatgtgctagctttctctctccaccttcatggtaagcttagtgtggatcgcagcccagtgacttaacagaatgagatcgtgccatttatcaatggagtcaacacactgggcctacgtgtttcttcacaaaaaccaatttcctacttgggaatggagaaaaaattaagcaggtgaacggaattcttcccaagcttaaatttttctccattatttttgacattctttttattttttatttatttatttattttgagatggagtctcgctttgttgcccaggctagagtgcagtggcgtgatctcggctcactgcaagctccgcctcttgggttcacaccattctcctgcctcagcaccccctgagtagctgggactacaggcgcctgccactgtgcctggctagttttttttgtatttttagtagagacggagattcaccacgttagccaggatggtctcgatctcctgatctcatgatccccccaccttggcctcccaaagtgctgggattacaggcgttagccaccgtgcccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcgcaggcatctcaaaccaccgactggtactgcacagcaggaggtgagtagtgggcttcatctgtatttacagccactccctatcactccaattactgcctgagctctgcttcctctcagatcagaggcggcattagactcttatagaaccaccaaccctactgtgaactgcacataagagggatccaggctgtgtgctccttatgagaatctaatgcctgatgatctgtcactgtctcccatcacccccagatgggaccgtctagttgcaggaaaacaagctcagggctcccactgattctacatgatggtgagttgtataatgatttcattatatatgacaatgtaatcatagaaataaagtgcacaataaatgtaatgcgctcgaatcatcccgaaccatctctcccctgcggtccatggaaaaactgacttctatgaaactggtccctggtgtcaaaaaggttggggactgctggtctaggaaagcaaaagtccccacaacacaaaagtattcttcaatgactacaagagcgatcaaactccaccgaaacctccttctccgacgattcagtggcttcaccttgccaattattgggtatcaatagccaccatcatgatatgaacacaaaacaaagtggcagttctggaaaacaaggtgcagtgactggcaaagtcagtggccttggaaaggccaaaaaaaagattcaggggccaagtgtggtggtgcacacctgtaatcccaccactttgggaggccgaggtgggaggatcacctgaggccaggagttcaagaccagtctgaccaacatggtaaagccccatctctactaaaaatacaaaattagcctggtgtgatggtgcatgcctgtaatcccagcactatgggaggctgaggcgggcagatcacaatgtcaggagatcgagaccatcctgggtaacatggtgaaaccccatctctactaaaaatacaaaattagccgggtgtggtggcacatgcctataatcccagttacttgggaggctgaggcagtagaatcgcttgaacccaggaggtggaggttgcagtgagctgagatcacaccattgcactccaacctgggcaccaagagggaaactccatccggaaaaaaaaaaaaaaaaagaaagaaagaaagacaaaagaaagaaaaagattcagggcaattcacagctgaatgaacgctaagaccacaggggctttgagagacttaaacactaaagaagtaaaagaagcccttaggaaaactggtgacccatcaaataaatctgtaagaatgatcctttttagctcgggctgcagaagtcaagcatgacatgaagatgtcgttttatgctcacatgatttcatccctcagcccagaaaaagttacagaaaaaaaccccacacccactcttaattcattttatactgaatctacaaattagcacctacttgtaattaaaataaaattcttattacatgtaagctgaaattaacctatttttataatttgcaatgttggttttcttttcttttcttttgagacaaggtctggctctctcacccaggctggaatgcagtggcgtgatctcggctcactgcaacctccacttcctggtctcaagcgatcctcccacctcagcctcccaagaagtgggactacaggtatgtgctaccacaccaaagtaatttttgtattttttgtagagacagggtttcgccatattgcccaggctggtctcgaactcatgacctcgagcaatccacccatctgggcttcccaaagtgccaggattacaggcgtgagccactgtgcctggcctgcaatgtcatttttcaagctcagtcaaatattttgcccactctctttccctcctccacacacatactatctacagtgaaactttggtctctgttttaagtgatctttttctggaacgaattatcttcagatagtaaaaatttccttcatttcatgccatttagttcagttagtgtaatgaaaggtcacgtaacaaaatgttaatggtgatgagttttggatgatagaatcataggtgccagcaagttctcttttacttaaatatatgtttaagtttttctagaatgaatatacaatattaaagactttttcaagttacaaataaattttttcagagcactgtagaaatgcttacccatctgtcgctccccctccttctcctttgctaacagaattttctttctttttggtatttagattaaaatgtgcttagtgggacctcagctccagaaaagaaccaggaattgctgggtatggtggcttatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaagacagatacctgactccaggagccatcactttacaacctgagattacagctccaagattgcctttgcaaggctccacctgctggtctttggaggtaatggcaggccctgcctagaagggccaagattctggtcctacctgtggagtctggctcactgtcagaaagttggggcacttatacctgagtccctctatcttgggggcggggtcgtggcatctctcaggcacacctggattccggcctcaagaacttccagaattgggctcctctcaactcccaactcagatccctgggttcccacctgttggtgccctttcagagggggtgtgagttttcgagtttcttgtactcttcgcctgacctggtacacttgtttgcattaactgcctagtccctctgtttgacttgggggtggctatttcaggggctccaaagtgttctaaatagaaggtgagaaggcctgggtgcagtggctcatgcctataatcccagaactttgggaggccaaagtgggaggatcgcctgaggccaagagtttgagaccaaccagtatagcaagatcctgtcacttccaaaaacaaaacaaaacaaaacaaaaacaaaacaaaaaaacccacctttttaaaattagcttgacatgacagtccacacctatagtcccagctacttgggaggctgaggcaggagaattgcttgagcccaggaggcggaggttgcagggagccgagatggcaccactgcacttcagcctgggcgagaaagtgagaccctgtctcaaaaataataaaacaatagtaaaaataataacgtataaacatgaaagtaataggcacaagtcttaagtttggaaaaaccagcattaacaatcttcacaagaagctacaagatagagactatcaccccttttgacaaatgaggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggaccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacgtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgacctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcccaaagtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctcctcgtggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtctagagtaggcaaagccatggagacagaaaacagacttgtggttcccagaggctggaaagaggtgggaaatgaggaggaactgctcatgggtataaggtttccttttgaggctataaaaatgctctggggccaagtgtagtggctcatgcctgtaatcccagcactttgggaggccaaggtgggaggattgcttcaggctaagtgtttgagaccagctcaggcaacaacagccggaccccctctctacaaaaaaaaaaaaaaaaaaaaaatagctggccatggtggtgatcacctgtagtcccagctacttgggaggctgagtcaggaggattgcttgatcccaggagctcaaggtaatagtgagctatgattgtaccattgcactctagcccctgggtgacagagcaagaccctgtcttgaaattgatagctgtacaacattgtgaatgcacttaatggcactgttttctttaaaatgtttaaaatggtaaattttatgtcatatgcactttaccatttaaaaaatagcagtcctctcctactgggtgaataggagcatctgaaaataatcagatcagggacggaggagtcaaggcacaaggcgagtcccgccatgctgtacgtggtaaggcactattgtcatgatttttccttactggatactagattttcccatggttgaggtcacagttcaggagacaggctccaacccgtctcacaggaactgctttccccaaacgataaacatcagtactgcccaagactctgatggccataaagcgtatcctcttccctgcaagtgacttagggagaaccacagatccatctctcagttacagctagggtgaaccaagcaacagagggttaagtgacttgaccgaggtcaccaaagaagatcctggcagcaccaagcccagcctggcccgcccccaggtatgagcatggtccattatgctatccagcctaggcccatccaacagaaacagaaactactgatcgttcgttcattcattcattcattcattcattcattcattcattctgtacgtcccagatgccatgcaaaaggtgctgggactacattagaacattaaaaaaacacaggatcccagccctcaagggccttttagtcaagggctggagccaattagagagtgggaaagtctggctgggtgtggtggctcacaactgtaatcccagcactttgggaggtcaaggcaggaagattgcttgagcccagaagtctgagaccagcttgggcagcacagtgagacccccatctctataagaaatttaaaaattagctgggcatggtggcattcacctgtagtcccagccacttgggaggctgaggtgggaggtttgcttaagcctgggaggttgaggttgcagtaagccgtgattgtgccatgcactccagcctgtgtgacacggtgagaccttgtctcaaaaaagaaaaagaaagaaaaagagagagtgggaaggtccttccagggctcagtccactcagggacaatggtatgtaatgtctgggggtgctgcagaggaatattctttgaaggtacaggattgttgggcgcagtggttcacacctatgatcccagtactttgggagaccaaggagggcagattgctcacactcaggagttcaagaccaacctaggcaacacagtgagaccctgtttctaccaaaaatacaaaaaattagcagggcatggtggcacatgcctgtagtcccagctactcggcaggctgaggcaggagaatcacttgaacctgggaggtggagggaggttgtagtgagccaaggtggtgccattgcactccagcctgggtgacagagggagaacccatctcaaaaaaaaaaaaaaaaaaaaaaaaaaggaaacaggattgatggagacggaggttctcaccatcccctaaaaggagaatgaatgagtcaacatatgcctgtctaaatagccatcaaccatttactgagcacctactatataccacatctgtgtcagaggctggagataaagaaatcaatgatagctcctgcccttaaagaacttaaatcagagggggagacaagtacattaaaacacgtcgtaagaacagagaatgataggaacaaggaagggaaggccctaacccacattgggggtggtcagggaaacctccaggtggggaggtattccctgcactgagtcttaaaggacaacaaggtgttaaccagctcaagacaaagcagggacatgggcagaaaaacaggacacggggtccgtgggggtgaactataagcagcttggtataagcggctccatcggaccgaaatggagaagcaaagcaagggttagaggtaagcggggcccaggagcaacatccagcctggtggggctgggagtggggggctgcctgcctggacacccctcttccccattccatcacccaggaccctcccacccatcctgcaaacaccagctgcaagtgccttgagtccggggaaccccctttctcctcttcagtcccagcacaggccttggtatagaataggtgctaactaaatgcttgctaaatgcatgccaggggaataaattaatgatacagcttcctgggagcagggacagcctgacttcacctccgtgacctgggggccttgcacggcggcagtaggtactcagtggactacactgagccaggccaggggctatttcctgttcaatcagtgtcccctgtccccaggacaagcctcccaaagagaagagcccagtctgtggtcacctgaacaaaggtcaatcaagccccaccctccttcaggcctcgactccatctccagctcctctggggccatgtccactgccacgccccttttgaatgtaggtatcatttacagcccaacctgtcctcactcaagcccttgacctggaggcagtaaagggcagtggctaagggctcagaactgggtatggggtacttgaatttgaaccttcactttgctacttcttcgctgtgtgaccctgggcaagtcccttaacctctctgagtctcacttatcctcatctacaaaacagggaggcatacgaacaagcccttcatagatgtgctgcgagataatgctcgaaaagcatttagcatggcggctggtatgtagtaggtgctcaatcaatgttatttagtgactcttactatgctcccttcatttcacgagagggaagtcttgccaccttagagccttcaatatgctgttctctccacttggaacacttttcccctcatcttcccacagctggttccctctcctcttttagagctctgcctaaatgttacctcctggactgtgacccacacactactgtatctcctgcaccccgcacagtgccagggacagggtagacactcagtcagctgtaatcccagcacttcgggtggccaaggaggtcagatcacttgaggtcaggagttcgagaccagcctggccaacatggcaaaaccccgtctctactaaaaatacaaaaattagccaggcatgatggcaggcgcctgtaatcccagctagtcgggaggccgaggtaggagaatcacttgaacccaggaggtggaggttatagtgagctgagatcatggtgctgcactccagcctgggcaacagagtgagactctaaaaaaaaaaaaaaaagaaggaaggaaggaaggaaagtaagaaagaaaggaagaaagagagatgagagatagagaaaagaaaagaataaaaggaatttttaaaaagaaggaagaggccgggcatggtggctcacacctttaatgccagcactttgggaaatcgaggaggtcagatcacttgaggtcaggagtttgagaacagcctggctaacatggcaaaaccccgtctttactaaaaatacaaaaattagctgggtgtggtggcgcatgcctgtaatcccagctactcaggagtctgaggcaggagagtcacctgaaccaaggaggcagaggttatgtgagccgagatcatgccaccacactccagcctgggtgacaaagtgagactgtctcaaagaaaaaaaaaaaaagaataaaatgaatttttaaaaagaaggaaggaccacactgccttttcaactccatcactagcttctgaaagaggaatatgacttccatcctctttgtttgggacatctctcccagtgccgtgcacacaacaagcacttaatccatacttccaggtagatctgaatctctgctgagttctgtaaaagctttctaagcaagccagggtatgacgatggagtgaaggtaagactggtgcaggcagccgcacatctcacggcagggtcgtggggcttcagcatcgggctcttcctcccacattattcagccacttctccttcacctcgacccagcccaaccatagttggctgtgtttctgcctctctggccccacgagcccctctccagctggttaaattcagaggtttcaacatcccagcctcctgtgtcccagccggcatctcatgggccctgtgccaccagcaagtcccagctgcaggcccaggatttccctcttgtgaccgtattaggaagcagctccagtttttctctgacgctttatatggtcagccacagagccctgagcagggggtgctcccggggcctgcagcagaaatgaggaacagggagggaagggagggaagtggaaggaacactggctttcagacacacagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagacagacgtggtccaccaagcacgtgcttttgctgcagccttgcttttaagagcaaaaagactagaaacaacctaaatacctgtcaatagcagacaggcttaatcattatggttcatccctatagcagaagactgtgcagtggccctctctctactaccatggatgaatggccaaaatacacagttagatgcaaagattgagacgcacaacagccggggcctgtgctgccattttggaggggtgcaggaggggctctctatgtggctgcatgtgtataaaacatcactggaggctggatggagcagctcacacctgtaattgtagcactttgggaggctgaggtgggtggatcacttgaggtcaggagttcaagaccagcctggctaacatggcaaaaacccatctttacaaaaaatacaaaaattatctgggtgtggtgatgcacacctgtaatcccagctactcaggaggctggggcgggatgatcgcttgaatccagaaggcataggttgcaggagccgagatcgcaccattgcactccagcctgggtgacagagtgagactttatcacaaaaaaagcaataggctgggcacagtggcttaagcctgtaatcccagcaccttggcaggccgaggcaggtggatcacctgaggtcaggagatcgagaccagcctggccaacatggcaaaaccccctctctactaaaaatacaaaaatcagctgggtgtggtagtacacgcctgtagtctcagctacttgggaggctgagggaggagaattgcttgaacctgggagggggctgttgcagtgagccaagatcatgccacttcactccagtctgggtgagagagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatatttgaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggccaacatggtgaaaccacttctctactaaaaatacaaaaattagctgggcgtggtggcatgtgcctgtaatcccagctactgggaggctgaggcacaagaatcgcttgaactcaggaaatggaggttgcagtgagccaggatcacaccactgctctccagcctgcgtgacagagcgagactccatgttaaaaaaaaaaaaagatcagaagggctaatgcttggggcttgacaaagggcagcttccagttacagtgtctttctaccctctagggaccagtgcagtggctggcacccaggaggcctctgttcacaatctgcttgttccttgtgtccccgggtggacactgcttccagagtaggctaagattgctgggccaggtctctaaggcggaaaaattgtcacctgctaaagtttggaaggagggcttctcctgaccccctgggcattccagaagcagaaccagaactggaaaaatgtcctttggggttcatggttcagggacttgggcttggagttccaatgagcaggggggcccatccaccttggctctggatcatgattttcccaaccccagaggtttggtatagggtggagggtcccactgtctacagagacaaagcaggtaaggcatgagtgaagcagggcgtgtgtgagtgaacaaaagaggtgccacggtcaatggttaccatggcctgggagacgacagggagtggtgaggtctgcggaaaagcagagcaaaaagcccatctcacagggactgctactcgcactctgcattctgcagtgtcaggtcctctgctttttcgagcaatgccagaaacagatttctttttttgatatattaagttaactcaatttaaaaacaaaaatcactcctctgtgttagcaggttgtaatcattagtctagcacctagttaggtgctcaaggaatcataataaaaggttcaattccttcttgctctgcacttaaagcttgtctacctcaaagctaacaaggcctctggcactgtcccctcctgctccagcccacgaccatcacctcctgctctaagcctattaccccaagagccctttgctactaatcataggtagtcaccctggccctggactcacacagaccttgtctgaatcccagctctgcccaccttccagtggtgggactaagcacatctgagcttcagcaacctcatctttttttttttttttttttttttttttttttttttttgagatgtagtctcactctgtcacccaggctggagtgcagtggcacaatatcatgcctgtaatcctaacactttgggaggccgaagtggtgaagattgcttgagctcaggagttcgagatctgtttgggcaatacggtgtgaccccacctctaccaaaaacacaaaaaaattagctgggcatcgtgctacatgcctgtagtcccagctactaaggagactgagataggatcccttgagttccaggaggcagaggttgcagtgagctgagatcatgccactgtactccagcctgggcaacagagtaagaccccatctcaaaagaaagaaaaagaaaaaagaagaaagaaaaaagaagacagaaagacagagaaagaaaggaagaaagagagagggagggagggagggaggaaggaaggaaggaaggaaggaagggaggaacgaactaactaactcgaggcagacgaactcagccaaaagacagcattcagaagaccaagggacccttaggaccaggcgtcaaagccatgctccccgccaggtatgccacaaacggtcttcagcagtttaggtagactgctggacattgctgagcccagaacctgcatctctaagattaggaggaaagctcctctggcttctatagactcttctagatccaagagcacaagaggtctgccagaaccttctcaagggcacatcgtttgaggcgagccttgcagaacggaggagaaagtttatcttcatcacagagggcaaagtcatgcatgccagaccacggacctggtatcacctcactacccgcctattaacaagactcatgcatgctgctattatgggctgggagagtaagttactgtgctcccccaccccaacccctttccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatgaaagacctgggccccaaagagtccaattttccctctagctccctacagacgggcctctttagaaatatccaacatactggctgggcgtggtggttcaggcctgtgatcctagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgcaatgagccaagatcgctccacttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttacaaggggtatctttggggcttcctgagatatattacacaagtcaacactgagcatttccaaatggaaaaaagagcaagtcactaaactgtgtgcccaataggcttttaaatatgtaaacagataccatgctcacaaagagacaaagaatgcaccgcatctctggttaaggactaatttttctgttttgtgttcactatgctttctgaactctccaagtgttccatagtgaacgtgtcttagtttcctaattaggaaaaaaatgtgcaggacatttttagagatgacaaggggctttttgtaattttcatttggcaaaatgtacagaccagaaccaaagagacacaaggatgccaagtgatggaagaagaacatcttactagtaaaatcaaaagtgatcatgaccacagcaaaaaccaatctagtaacacttaacattttcagtgcctgcacttaacatgtagcaggaagtgtattaagtgctttctatttagagtaacccactccatgaagctggtactatttttttttttttttttttttgaaacagacaaggtcttgctctgtcacccaggctagagtgcagtggcacaatcatagctcactgcagccttgaactcctgggctcaagtgatcctcctgcctcagcctccctgagtagctgggattatgagtacgcaccactgcacctggctaatttatttttgcagagatggggtctcgttgtgttgcccaggctggtctcaaactcctgggctcaagtgagccacctgcctcagtttctcaaagtgctgggattacaggcatgagccactatgcccggctcccaagaggctggcactattcttgcatccattttacagaaaaggaaacaaagcttcagaggcatgaggtaacctgctcgagggtgagcaaggcctttcagagagaagacatagacataggccgggttgggtgacctctgcacatcagtctggcgacccgtgccccacaacatcacactccaagccccaatcatctagtccaagcagtccaacagaactttctatgataatgggaacattctgcacttatgctacccagtacaccagccactagccacaggtggctattgactacttgacctagggccaacacaacaaaagaaataaatttgttattttttattgtcttttacttatgtatttatttagagatgaagttttgctcttattgcccaagctggagtacaataacgcgattttggctcactgcaacctccatctcccaggttcaagcgattctcctgcctcggcctcccaagtagctgggattacaggcgcacaccatcatgcccagctaatttttgtatttttagtagagacggggttttaccatgttggccaggcttgtctagaactcctgacctcaggtgatccacccaccttggcctcccaaagtgctgggattacaggtgtgagcccacgcacccagctaataaattttttaatgtttcttttttttttttttttttttttgagatggagtttcgctcttattgcccaggctggagtgcaacggcaccatctcggctcactgcaacctctgcctcccgggttcaagcaattctcctgcctcagcctctcaagtagctgggattacagatgtgcactaccatgcctggctaattttggcatttttagtagagacagggtttcatcacgttggccaggctggtctcaaactcctgacctcaagtgatctacccgccttggcctcccagcgtgctgggattacaggcatgagtcgccaaacctggtctaatgtttcttttaattaatttaaatctaaatttagttagccacgagtggccagtggctaccatattgtgccatctctagtccactctgttctgcaagtctacctaaaatagtcctacgaccaacctgaacattcccctctgtgacaaggaaggcctccctaaaacctagccacatcctcatgtctcctacccacctggctgccaagacaaaccagcctttccaaagtggttatgagctcttctttactttcaagaggaaggaaggacagagaacgatgccaatgaaatctgttgagagtttatcatacgtcttggcacttggcacatgtgatgacatgggattgtcacacctcctgtctgtaatgagggtgattattcccattttacggataggaaaaccaaggcttcgagagaggaaataacctcttcaagggctgagatgtgaacccaccttggaatgattccacctcatcttgcaatctccctcgatcaaaccttcagcctcccatttcctttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctcgaacttctgacctcaggtgatctgcccacctcggcctcccaaagtgctgggagtacaggcatgagccactgtgcccagccctcccaacacatttctaatgcctactttccttatgaggccaggagtaggtacctggctgcctgcaatactcacatatattagccctgagaagtaccgctccctcaggttgtgtagcacggaggcttcgttgaggcacgtcagctccgccatgtcctccaccttggagaacttgggtgggttcatcttctggatgtcatctttcccaaccgtgaccttcttgccattctccaccagctccacaaccacctcatcccccttctcctccttaatgctggctgcctcgaagccctgcttctccgaggggacccagacgagtctcttggcggcccagtcagcctgggccactgggctgttgatgaagtttttgtccacaaagaggaacttctcatcgtcactgagttggcccttctgcgccatggtgccttgttggtcccctgtggaataaggtaacagggtcagaatcagaccacaaccaagcccggaagacagaccaaccactcaccttgccctgtctaggaactcggtctgcagagacatcccaccaagtacaaagacctgcagtattgtgtatgtggtcaaagaacagagaccacccaaaggcccttcagaaagggatgtgtgtcatcgcctaaaataccaaaagtcagacaacccaaatgtccaccaacatacagctggatacataagccatgctatttccacactgtgaaatactacccagtgctcaggaggcaggaagtagggctggacaaggtggctcacacctgtaaacccaacactgtgggaggccgaggtgggcaaatcacttgaggccaggagttcaagaccagcctggccaacatggtgaaaccccgtctctactgaaaatacaaaaattagccaggtgtgatggtgtgcacctgtaatcccagccacttgggaggctcaggcagaattgctcaaacccaggaggcagaggttgcagtgagccaagatagtgccactgcactccagcctgggtgacagagccagactccatctcaaaaaaaaaaaaaaaaaaagaagaagaagccggaagtaagtgtacacgtgctaatatgggaagatggtcaagtctaactgtgcgctgcaaaataagagtcctcatacgattaaacatagaattacccagattccttgagcccaggagttggagaccagcctaagcaacatggcaaaaccttgtctctacaaaaaatacaaaaaattagccaggcatggtagcgcacacctgtagtctcagctacttgggaggctgaggtgggagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaatcagaaaggccacacgctctattactccttcaatacgaaaaactattaggctggtgcaaacgtaagtgtggttattgagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctcgaaaaaaaaaaaaagtaatggcaaaatagaaaaggcatatctatggtgacaggcaatcaagagttgccagaggaggccatgcacggtggctcacacctgtaatcccagcactttgggaggccaaggcaggggggatcacttgaggtcaggagtttgaaaccagcctgcccaatgtggtaaaaccccatctctactaaaaatacaaaaattagccgggcatggtggtgcacacctgtaatcccagttactcaaaaagctgaggcaggagaatcacttgaacctgggaggcagaggctgcagtgagccgagactgcaccattgcactccagcctgagtgacagagtgagacgctgtctcaaaaaaattaaaaaaaagagttgccagtggcaaggaaaggaatggattagtaagaggcacagaagaggtacataagaggtaagaggcaccacctttcggggtgataaaagtattccctgtggtcatggtggtgcttacaagactgtatacatttgtcaaaactcattaagaatgttctatccactataggatgagtaaagtgaacaataaaatattacatcgtttccaagagctagaagaaggacattgaatgttcccaacacaaagagatgataaatgtcattatataggaagtagcaaaataaaagtaatggcaaatgcttgagatgatggatatgctaattatcctgatcttatctccccacacattatatgtattaatatcaaaacattactaagagctggactcagtggctcacacctgtaatcccagcactgtgggaagctgagacaggaggatcccttgaggccaggagttcaagaccaacctgggcaacataagaagcccctgtctctgtaaaaaaattaaaaattagcctggcacggtggtgcatgcctacggttccagctactcaggaggctaagacgggaagatggctagagcccaggaggtcaaggctgcagtgagttgtaatcatgccactgcactccagcctgggccacagagcgagaccctgtctcaaaaccatccaaccaaacaactaaaaaaatcattatggaccccatgaacatgtatgattatttgtcaattaagaaataaattttttaagttgaaaaaactcactcaagctgtacacttaaaaaaacttgaatttgttttaaatcggtgagttttactttatatagattatacctcaataaagctgattaaaatatttgtcataaagtatttgtcttcattttatatgtttgtgtgtacatttctaaaagtctagaaaactgcataccaaaatattatactagggttctatctggtcaaatacgagacagtgtgaatatcaataagaaaaataattatatgtccatcaccctaacaccccaaaaagggtggaaagacaaatatatttaaatgcatttgttcaaaatgatttttgttgttgttgtttgagatggagtcttgctctgttgtctatgctggagggcagtggtgcaatcttggctcactgcaacctctgcctctgggttcaagcgattctcctgccttagcttcccgagtaactaggattacaggcgtgcaccatcacacccagctaatttttgtatttttagtagagacggggcttcgccaagttggccaggctggtctcaaactcctgacctcaagtgatccaccagcctcgggctctcaaagtgaagggattacaggcatgagccactgtgcccagccccaaatgcattattttttaaatgggtacagaaagtggggtggaaatgtgaaaatcttgattctgcgttttctatacaaattgttccttagggtaactaaattaagaaggggaagtctctcttgatggaagattaggtcattaaatgtcctgtctacatgggaagcccatggatggtagattcacgttatctgtcgttatccagatgtgtttatgaggagagggacagagacaacacactctataggcctgtccggccccccgttcctgactctctgaccatagctgcaggggctgtcctggaaacactggcttacagccccttctacctcttgctgctgggctccaaagaactgagttgctggctaagtgaggacatatggccaccaggatctatgcgtggttgacatccctccttcagcagggaattcacaactcctttgaattcactgataatccccacgcttgggccccaaatcccacagcgacagaataaagacccatgtcccactcctggatccctagagctgagcagccaactcctgaaacccaaccttttgggtgatgcagattttgcaagacagaatgggagtggcagatattccaatacctatttttttcctttcagggctgaaaataataattaaaaaactaattttaagaacctgctgctgggtgcagtggctcatgcctgtaatcccagcactttgggaggccaaggccggtggaacacctgaggtcaggagttcgagaccagcctggccaacatgtgaaaccccatctctactaaaaatacgaaaagttgctgggcgtggtagcatgcgcctacaatcccagctactcgggaggctgaggcaggagaatcacttgaacccgggaggtggaggttgcagtgagccaagattgtgcctctcaccgcactccagcctgggcagtaagagcgaaactcagtctcaaaaaaacgaaaaacaaacctggaagttgatttgctcagagattttctgctgggagacctgatatcgtagctgatgaaaaaaaagtggcggctaggtgcggtggctcacacctgtaatcctagcactttgttggggctgaggtaggaggattgcttgaggtccggagttcaagaccagctggccaacgtggcgaaacctgatctctactaaaaacacaaaaatattagctgggcttggtggcaggcacctgtaatcctagctactcgggaggctgaggcacgagaattgcttgaacccaggaagcagaggttgcagtgagctgagatggtgccactgcactctggcccaggcaacagagcaagacttcatccaaaaaaaaaaaaaaaaaaaaaaaaaaaagggcagagaaatgaggaaatcccatctaaatctgaataatcacttcagatatccagaaagagaaataaagatctggtagacaacatgtattgtcctaagtttaacaatcctcctttctgcattttaaaattgttattgaatttggcttagctcatagtaagaccaacagtgtcctgcccctgactccagttaccctatcttaaaaaagactcccttctacatggaagaattccagcgaatacatgcagaacaataaaactaggatgtaactgtttataaagctaatagtgggtctcaagctgggcacggtggttcacacctgtaatcccagcactttgagaggcccaggtgggcggaccacctgaggtcaagagtttgaggccagcctggtcaacatgggaaaaccctgtctctactaaaaaatacaaaaattagctgggcatagtggcatgtgcctgtaattccagctactcaggaggctgaggcaggagaattacttgaactccaaaggtggaggttgcaatgagccgagatcatgccactgtactccagcctggacaacagagcaagactttgccaaggaaggaaggaaggaaagaaagaagaaaggaaggaagaggccgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggacgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacctaaatctactaattaaccctaacatcacaaaaagagagagctgactagacattataaacattacatgcctgcagatgggccactacaggaagtgccgttaccactaatgacatattcttgctcaaaagaaaaggggatggagatgggggatgaaggtgatgaagcctccagatctgacgcctgtctatggaaaatgcaaggcacaggagagcatgctaaacaatgcagtaaactcccaaaggtgagagactatgctctgtcgcccagctagagtgcaatggcgggatcttggctcactgcaacctccacctcctaggttcaagtgattctcctgcctcagcctcccgaggagctaggattacaggtgcatgccaccacgcctggctgatttttgtatttttagtagagacggggtttcaccatattgtccaggctggtctcaaactcctgacctcaggtgatctaccggccttggcctctcaaagtgctgacattacaggtgtgagccaccacgctcggccagtactctctttctttaacaaataaaatacaaacaaaaaggaggggaacccatagattaaaaaataattgaaagaaaagaggctggcagtagcccacatgtataatcccatattttgggaggccaaggcaggaggattgcttgagcccaggagttcgagaccagactgggcattatagcaagaccccatcccttaaaaaaaatatcagccaggcatgatgatgcgtgcttgtagtcccagctactaggaggctgaggcaggagggttgcttgagcccaggagtttgaggctgcagtgagctatgattacatcactgcactccagcctgggtgtcagggtgagaccctgtctcaaaaaagagaaagccacagagaacgagaacatttcataaatatagggcattttcattagcctaaaagatctttctgagcctaaataaagtacaagttcattggtgctggcaacatttgattggttgcctcctcttgagaggtaagataacctgtagtcatgtaaagacacccagactttgcaatcagatgctaattcaaacgtgactctgccactgcagaatgcgtgcttctgggtgacttacgtagatctgagactcagatttactgtatattaatactggggacctaacgggtgccctgcagagctgccatgaagtttagatgaaactctctacaccaagcttgtctaacctgcagcccacaggctgcatggggcccaggacggctttgaatgtggcccgatacaaattcataaactttcttaaaacagtatgatattttttcgcgatttttttttttttttttagctcatcagctatcattagtgctagtgtattttacgtgtggcccaagacaattcttctttttctggggtggcccagggaagccaaaagataggacacccctgatctacaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagagaaaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcgacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacaccacaaaaaaggacatctcacaacacatccttgagcaaaagaaggtggtcacaaaaagcacaggttctgtgactattgaactgaggtccaaaaccaggcagaattaatctacggtgatagaactcagataaggaatgaatgagtctccggtgtgcaatgattgcaaggacagaacgtgaggggggcttgtgagggttgacctctagatcttcatctgaatgccagccctatgagtgttcactttctgaaaattcatcaaactgttgggccaggtgacatggctcacgcctgtaatcccagcactttgagaagccaagatgggaggaccacttgagcccaggagtttgagaccagcctggccaacacagcaagacccatctctaagaaaaaatgttttttaattacctgtgtggaagactgaggtaggaggataacctgagcccaggaggctgagaccggcctggtcaacatggtgaaaccttgtctctagcaaacatacaaaaattaaccggttgtgatagtgtgcacctgcagtcccagctactcaggaggctgaggtgggaggatcacttaagctcaggaggtcggggatgcagtgagccatgatcatgccactgcactgcagcctgggtgacagagtgagacccccatctataaaaaatatatcctcttgaaaattcatcaagctgcacacttttttgcacatcaagcgtacttttttggttgtaaagtacacttcattttccttccctcttatctttaattgtggtaaaatacagctaacattcaccacctcggccacttaaacacagttcagtagcattaagtatattgatattcttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgtccaggctgaggtcttgaactcctgacctcaagtgatctgcctgcctcggtctcccaaagtgctgggattacaggcatgagccgctgtgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtacaaaaaaggagagcttggagcaggctggattccctctggctttgatgtctctgacagttacgacgtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtcttttttttttttttttttttttgacacagagtctcgctctgttacccaggctggagtgcagtgacgcaatctcagctcactgcaacctccacgtttctgggttcaagtgattctcgtgcctcagcctcccaagtagctgggactacaggcatgcgctaccatgcctggctaatttttgtatttttagtagagatgaggtttcaccatattggccaggctggtcttgaactccaggcctcaagcaatcctcccaccttggccccccaaagtgctgggattacaggcgtgagccaccgcagctggccacaaactctgcactgtgactcttgggctgcgtcattctgtgtcgtgaggggagctcttccgtgcattgtgggatgttccgcagcatccctggtctctgcccacctgatgccagtagcaccccttcctccactcatgacaatcaaaaatgtctccagacactgctagatgtcccctggggtggcaaaactgcttccagttgagaaccacagctttagaataaaaacaagggctgtcttgggaaaggcagttaaagctgagagcagctctcacttagtcaaactcaactcggaataccaactgcagaagatcagacgggggcaaggtgaacacactggaccagagacggaccgccagttggcccaaccccagggacactcttcatctaccttgatgcaccttcccaaccctccctcctccaccatcgctcatgtttaaggtcctgcatcagctccaagggctgaaaggacatctctgaaattactacccagaactgctgaccacgaagtacagttcactcatcaagagctgctctcaatgtttttggttgggggaagggtctcactatatgcccagggtggagtgcagtggtgcaatcatagcttactgcaggctcaaactcatgggctcaagggatcctcccacctcaggtgtgggccactatgcccggcttattttttgtagagatgggggtcttgctattttgcctaggctggtctcaaactcctgatctcaaatgatcctcctgccttggcttcccaaagctctaggatgacaggcgtgagtcacctcgtccaactttctcgaatgtttggatgaaaacaaatgactctgtcacctttggcattagcgatgtttgacacatctgagtgtgtcagccttgtttacagtcctgtcctgaccaacaactgcttcattctttttttttgagacagggtctggctctgttgcccaggctagagtgaagtggcgcgatctctgctttctgcaaactctgcctcccaggctcaagccattctcccacctcagcctcccaagtagctgggatcacaggcacgcaccagaacacccagctaattttttaattcttgcatttttttgtagagacaggggtctcactttgtggcccaggctggtctcaaactcctgagctcaagcgatctgcctgcctcagcctcccaaagtgctaggattacaagcatgagccaccgcgcccaggctgcttcattttttgagcacaaacaagctaatcattagcctctggaagaccttaggatgtcaagtaacgagtctcagctttgccccaaacctgctgggtgactctggacaagtcacttgccctctctgggccttgtatttttcatttagggaaaataaatcaatggtaggctggcccagctctaccattttatgggacccgtctgtgactcccagtcaaagggctgaaactggaccaactgagaatgtcaggttgctttagtttgttttaccatcagtttcatttttcccagaagaactcaggggcaaaagatcttgccctctctgcttcagcattaataaaaagtaaattaggccgggcatggtggctgatgcctgtaatcccagtacttcgggaggccgaggcaggcggataacctgaggtcagtagttcaagaccagcctggccaacatggtgaaaccccgtctctactaaaaatacaaaaaatagccaggtgtggtggtgggcgcctgtaataccagctactcaggaggctgaggaaggagaatcgcttgaacccaggaggtggagggtgcagtgagctgagatcccatcactgcactccagcctgggcgacaagagcaaaactctgtcttgaaaataaataaataaatagtaaattaaatatcccagagcccagagagtataggatttgcacatcacctcacctggtcaacagcttccctcaggattttactgccaagccattggctaaagattttggaccagagacaaaaacccaaatgtttttggagatcaggtaagtaatacagagtgacccagaccagatgttagagtattgcttatattctaaataccatgcagggttcagcactgtggctcacgtctgtaatcccaacactgggaggccaaggcaggcagttcgcttgagcttaggagtttgacaccagcctgcgcaacatggtgaaaccccatctctacagaaaatacaaaaattagccaggcatggcagcacatgccggtagtcccagctactcgggaggctgaggtgggaagatcgcttgagcctgggaggtagaggttgcagtgagccaagatcatgccactgcactctagcctgggtgacagagtgagactccatctcaaaaagaaaaaaaagaaaaaagaaaaattgctcatattctaaatgtcataaagggctggatacagtggttcacacctgtaatccaagaactatgggaggccaagccaagaggattgcttgaattaggagctctagactagcctgggcagcacagtgagatcccatctctatttcaaataaacgaatgaatgaatgccacacaggcaaaacagaagttctctgaacctgatctgcaacacaattcgccagctggaaggacctctgcagtggaaatcctcgctcaaggcctggtccaggtgtagggaggcatcaaatgtgtcgcagggagaggcactgggcactctaaatgcacctgcttggcaggtccccagtagtaccaaaaaggcagtttagatctattattcataacagccactgtatttattgggccccttgtattcatcaggtatcaggccagacagcttcctatatagaccatctcactgtctcctaagcgctctgtaaggtggcatcacctgctattgctattttcctgctaagatgaccgaggtcctggaaggtaaatgcaagacccccacttgtaaaatttggagtcaggagtacaatccagaatctaatcctagttttctgctaagagtaaatggacacccgattaattcttagcagaaagtccctttcttgcccctgaccctactccaccatttctaccctcccctcaccattcacatccccccacctcccaagggcttgttcccaagaaagccctacttcacttttacaggaaaaaaagtgaatggtgaacctgtcacattcttattgccttgtgacatctgcctaatcatctgaataccaatggtttcaagtaactccagaaagaagttctcttaatgcataacactattttttcctcccaaccaagagaacttggttggcaagagttacggtagcccctgtgaaggatgcttctggaagcgagcaagaactgattatttctggccctaaaagccccactgtgttttatattttacaattctggcataccacagcttaaaataaatgtatagtctcctatgtcaggggtccccaacccttgtgctgcagtatcagtcaatggcctgttaggaaccaggccacatagcaggaggggacggtgggtgagtgaccatcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgcctttttttttttttttttgagaccgagtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggaaccaggattagaatcccgatctgtttgaagcctaatttactcagagatggcattagcgatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttgagacagagtctcactctgttgcccaggctagagaacagtgatgcaatcagggcccacggcagccttgaactcctgggctcaagcaatcctcctgcctcactcaacctcctgaataactaggactacagatgcatgccaccatgcccagctcattttaaaaatttttttgtagagatggtgcctcgctatgttgcccactctggtctcaaactcctgacttcaagccatccccccacctcagcctcccaaattgctgggattacaggtatgacctgccatacctggcctctatggccctttcctagcaactttgatgaggttgttcctccttagcccctgaaaccctgatacaagtcacagatgtccgacctcccctttcagccactgtgagcagcttcttcctctgtccttggatcacatacaaggtttctttcaaattcttgcctgcctttctctaaattcagtctttcctccattgtgtggccagggttaaaagttgaaaggtcaggagtggaaggagaagacctagagagcaaaaaggccatcccttaaagtatgccatcaagaccctaaataagccaggcgcggtggctcacgcctgtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaattggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtgtttgctataaataaccatcactgaagcttaccaggggccaggcactgtgctaaacccttcatacacattagctcatcaaatcctcccatgagggtaatctgtgaaactctggagttagaaagacctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagacccagctagttcacgttctggactctcggcatggcagcccacctagggtcactggtttcagctaggtcaccccctcaatcaggggacaaacagtgccttttattttaaatgtgcaaaaagtcagtttatgttttcttcaaaggacacggtgataaacatttactttgttggaagcatttagtcccaccagaaacctgaccccaacaagtttgtgtccatggtaaagaagaaagatagtggggtcaagggtatgaacttggactcaaactgacccgggaatgggttctaccacttgctggctgtgtgacactttacctctctgagcctcagctgccttgtatactaaacaggcatcataaagcctttcttatgaagttgttgcaaagattaaatgagataaattaagttaaatgttgcaacagcatgtggcactgaagtgttccatcaacggtagctatctcaaagggaaaacatcaatttccttcaaacaaaattctctatcttatttcacaccctgccacctaatgactttcagttcagcgtcaagttccgtctctgaacaattctaaaatagtatcgttgagtaaatcaaagaaacaaaaaactatgcaaagcagtttattaatagcctgcattctttttgccaaaccccggacggacagttcaccatttaatctctcagttcttcatactgcaactaaacactcccaccttgggtttctaaatattttcttttacttcttgacaagcatggctttggatggtaccttttctcaagtggcaaaatccctaccagaccctgtgctggaagaaaacttacaacaggcagtagccacactttctctcgttttacccatttggttgggcacgagagtggcattgacacaggtggctctgcgggaaattctagtgtaatcttacctaacgcacctgcagatcgtggaagcaaatggagactttggagcccacctgggtatctgggggccctttggggtcaacctgggtgagttgttttttttttttttaatttggagaagaggaaaaagtgggctgtaacaaactagatcacaaccagccttatctcccaggggttctcaacatagaagaacctcccctaaactgattaaaaaaaaaaaacaacaacactcctttctgctaagcctatgcccatgtgtttttaactgatttaatgcattatcaacacaactgtgcaatacggtcaaatccacaaggagcctcactttgcccttctgtgtgatagcaagtgacttttcagtgaagttcagctgtaaattttttggtgcctagaataaaagtgagatgccttgattgtctgcaccggacctctgagatttccaagggagcatatctcctggattagcctcttaacaagaatcactcgggactaatttttttttttttaaggcagtttttctggggattctagagttgggaaatggagttgggtccaggcattgatatcgttaataagcacccccaaaatggtacttctcactggcaatcttaagaaatgctgtttggggaaagtctaggataatctaagacgataaggcagagagagatccaaatcacaactctgcccccaccatggcccttacgaggttgacaacagggacccctaagtgcaccccagcccctatagaataccctataggacttttaacacccccctgccctgcaatctgcccccagaatgacaactactacttacagatctccaactggggggactagtggagaggaaactggatggcgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaagagggccggctgtgcagcgtgaagggtagggaaaggggatttcttgaactttgcaaagtgcaagacaggaggcccccacccttgctgggaaccgtgcaggaaggggaagtttttacttttcccaacttgccatctccacctccacccacatcaccacgaccaaaatacaaataaaaattaaaaataagcccactgtgattatttcagctgtccccctcccctgtgcgccactcgccagctgcgtgaccttgggcaagtcacttcacttctctgagacttggtgtccatagctacaaaatgggggaaggcggtggcggtgataattacgttatttacaagatgcaagtgtcaagatccaaggagaaagtgggtgtgcccccagagtctgcgagttcccttcaacaacttcccttccccaaggattcctcgcctaaaattgcattccctgtctctctccatcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatggggacccctctgcttggggaaggcccggaagggggcagcccccagtcccacgtgggtttctgctgcttcaggctagaggatttggagagagggttaaagttgggcagacccctcctgggttctgtacttgacgcaggcccttagtctacaaccactcctcttgcaaccaggtggaggggctgggggccgggggtgcggggggtggctttattaatacccccattttgcaggtgagaaaattgagtccctgcaggggtaaagggatttgaccaagctctcactgggacagtcattgattggtgctggcactggaacctttctgatgacaccattcacttccagagaggagacattaaagggaaatgcccaggcaaactggccttgaggcccagggcgtgtatctgagagtagatgtctggctttgaatctgccagtgctgctttctacctatatgaccatgggcaagtaactttgcctctccatgcctcaatttccctacctgtaagatgggaagaacatcagctacttcctggcctttttgtaagcagtccttgagatgatccatgtaaaatgaacatggtgcaccgcttcatgtgagctgctgttactcgcaacaaacatgaaaccaactagagttgcaccaggcctccgggatataaagagaggcctcttcccctgcaggctcccaggcccatctggagagctctgcatctcagacccttttgggtccttcttcatccttccaacatcaagcttacctggttttcaccctggaaactcctgagcctggccctcaccctgcaatgggcctagatcagagagtcaagaacagcctgcatttagctggctggggaagtgaggggtaaagctctgcggaaaatgatgaatgagctgctccgcacaggcttttaacatctacgctgtaaaaggagtggaaatcgtccctgcatcagcacagaaatgatgtggagcagagaagtaacggaagggggaaaattgaagtcaatcatccgcttcccatcctggaaagggaaggccatcggaatctagcttgctggcctcgaagtaaaaactggcattaatactagaggcatgaacactgtatttccaaagggttccattcgattctttaaataacttgttggtaacttttaaaagagaataattataatgtgattaacaactggagactgtaacactcaattttacttcattctctcacctaccccttatataacaaccctttattaaaaattaaagtaggcagccgggcacggtggctcttgcctgtaatcccagcactttgggaggccaaagtaggcggatcacttgaagtcagaagttcaagaccagcctagccaacatggtgaaacccccatttctactaaaaatataaaaattagctgggcatggtggtgcacacctgtggtcccagctacttgggaggctgaggcaggataattgcttgaacccaggaggcagaggttgcagtgagctgagattgtgtcactgcactccagcctgggagcctggatgacagagcaagactccaactcaaaaaaaaaaaaaaaaagcaaaactaaagtggccaaggccaggcatggtggctcacaactgtaatcctagcactttgggaggccaaagcaggaggattgcttgagctcaggagtttgagaccagcctgggcaacatagcaagaccctgtctctacaaaaaataaaaagttagccatgtgtggtggtgggtacctgtaatcccagctccttgggaggctgaggtgggaagatcacttgagcctgggaggcagaggttgcagtgagctgagactctgtcactgtactccagcctgggtggcagagtgagaccctgtcttgaaaaaaaaaattttttttaagtagccagcctgggcaacatggtgagatgcaatctcaataaataaataaataataaatagcagctgggcgtagtgtagcctgaagttccagctactagggaggctgaggtaggaggatctcttgagcttggaaggttgagactacagtgaactatgattgcaccactgcactctagcctgggcgacagagcaagatgttgtctctaaaaaataaggtacatactttaattccctccctacccccattttattgttgagaatctaggtttggaggggttaaataacacagcagtggtggaacaggaattccaaccccagtctttctgacacaggccatagtagacagcagtctgaggttttaaacccagatctcttaagcaccaaccaagcacctttgggattgtcagtaaacctctctgagcgcattttctcaaggaaaaacaaagatgatcagattctttgcctcaagtacctttctgattgttaaatatgacagcacatgtgaaggcctttatgaaccatctccgacctctctagtaccctctggaagcaggcagggacagtatgttcacttaagagtcattcaatagatatgtgtccaatgcatgaagttccgatgtttgaatcttcagaagtgcattgttatcattcgatcagatgcctctgtttcatttctcatggctcaaaaggtcagttcttttaagatggaggaggcaatagtctctttttaaaatgtcactttgactgagtgctgtcaagtaattttccttggcatatctttttctgtgaccggctgtttaatgggagtttccacgaatccatgaaacaagacagccaaggggaaatttctctcttatagtctttttttgctgttggcttaaaaaagccccaaagtggctgggcatgcctgtaatcctagcactttgagaggctgcagcggaaggatcgcttgagcccaggagttcaagaacagcctaggtaacatagcaagatccctgtctctacaaaataataataataataataataataataataataataataataataattagtcgagcacagcagtgtgtgcctgtagtcccaactagagagtgaagtaggaggattgtttgagccccagagtttgaggctgcagtgaactgtgatcgtaccagtgcactccagcctgggcaacagagcaagaccctgtctcaaaaaaacaaaacaaaacaaaaccatgaagtgtgatcccctccaatttttagtaacatcgaagattgggtctgagcatggcttactcctgcatgtgcctcaagatttaatattttttggccgggcacagtggctcacacctgtaatcccagcactttgggaggccaaggtggagggaacacttgaggtcaggagttcgagaccagcctggccaacatggtaaaaccctatcactactaaaaatacaaaaactagtcgggtgtggttgtgcacgcctgtagtcccagctacttgggaggctgagacaggagaatcccttgaacctgggaggtggaggttgcagtgagccaagatcacaccattgcactctagcctaggctagagagagaggctccatctcaaaaaaaaaaaaaagaagatttaataattttaaagtgttatcagccttgatctacttgactcatatagagtcaggtagatctggcccaagatctgtgaataaaggaacatcgttcctgaccacaagcagggccatgctccaactcttgcacaaaagcacttttgtttcactcatggtggcccccatgatggacctcacacttctcccgatactagactgcattgcatagtaacctgcaatgctctttccttcatcatcagtttccaattctgatgtcacgatttggttcatgacattcctgatagattctctatgtctatcaggaagggtcctaaaactctcaataaaagtagttctacagttttttaaaaatgaaacacacagggcacggttgctcacgcctgtaatcccagcactttgggaggctgaggcaggtggatctcctgaggtcaggagttcgagaccagcctggccaacatggtgaaaccccatctgtactaaaagcacaaaaattagccaggcatggtggcgggcgcctgtaatcccagctactcaggaggctgaggtgggagaatcgcttgaacctgagaggcagaggttgcagtgagccaagatcatgccattgcactctagcctgggcgacaaaagtgaaactccgtctcaataaaaaaacaaaaacaaacaaacaaacagaaacaaaaacaaacacgctcttaccatataatccagaaaattcttcttaggatttgcccaaaagagttgaaaacttctgtccatacaaaaccctgcacgcacatgaagtttataacagctttactcactatcgccaaaacttggaagcagccaagatgtccctcagtaggtgaatggatacataacaatggaatattattcagtgctaaaaacaaatgagctatcaaggcatgaaaagacgaaggaaaattacagctgggcattgtggctcatgcctgtaatcccagcactttgggaggtcaaggcagatggatcagctgaggtcaggagttcgagttcagcctggccaacatggtgaaaccctgtctctgctaaaaatacaaaaattaaccaggtgtgatggtggacacctgtaatctgagctactcaggaggctgaagcaggagaatcgcttgaatcagggagatggagtttgctgtgagccgagatcgtaccactgcactccagcctgggtgacagagcgagactctgtctaaaaaaaaaaaaaggcaggaagaaaacttaaatgcttgttactaaatgaaagatgctaatctgaaaaggccacgtactgtacgattccaactatacaacattctggaagagacaggaataggtggagtagagaagattttctagggcagtgacactcctctgcatgatactaaaatggtgaatacatgtcactagacatctgtccaaaaccatggaatgtgcaggcagtccccaacttataatggttaaacttaacgatttttcaactttatgaaggtgggaaaatggtgcattcagtgaaaccgtactttgaataccgacaaaaccatgttttttcactttcaatacagtattcaataaattacatgagatggtcaacactttattataaaataggatttgtgtttgataattttgcccaatggtaggctaatctaagtgacctgaacatgttaagtaggctaggctaagctaagatgctcggtaggtgaggtgtattaaatacattttgggctgggcatggtggctcacatctgtaatcccagtactttgtgaggctaagatgggcagatcacttggattcaggagttcgagaccagcctgggcaacatagtgagatcctgtctctacaaaaaatacaaaaattcaccaggtgtggtggcatgtgcctatagtcccagctattcaggagactgaggcaaaggaccacttgagccttggaggcggaggttgcagtgagcccagatcgcacaactgcactgcagcctgggtgctagagtgagaccctatccaataaataaataaatgcattttgacttattttcaacttgtgatagttttgagatgtaatcccatgagtcaaagagcatctgtacaataccaagagtgaaccctaatgtaactatggactttttgtgataataatgtgtcaaaatagatccacccattggaatacatgtgccactcgatgccggatcttgacagtgggagaagctagacatgcatgggtgcagggggcagtcaggagctctgtgcttccagtccatttagccatgaacctaaaactgctctaaaaaacgagtctacttttataaaagtagttttgttttgttttttttttccagagaatagtctcactctgtcgcccaggctggagtgcaatggcgtgatctcagcgcactgcaacctccgcctcctgggttcaagcgattctcctgcctcagcctccccagtagctgggattacaggcacatgccaccacgcctggctaattttgtattttttgtagaaatagggttttgcgatgtttgccaggctgctctcgaactcctgacctcaggtgatacgcccgccttggcctcccaaagtgccgggattacaggcgtgagccaccatgcccagcctaaaggtagcttttttttttttattttttattttttgagacggaatttcactcgttgcccaggctggagtgcgatggctcgatcttagctcactgcaacccccacctccacagttcaagtgattctcctgtctcagcctcctgagtaactgggattacaggcgcatgccaccgcgcctaattttttaatttttagtagagatggggtttcatcatattggtcaggctggtctcaaactcctgacctcaggtgatccacccgcttcggcctcccaaagtgctgggattacaggcctgagtcaccaagcctggccagcagttttatttcacttttattttaataagattcctgaacaccacacaatcctcgaatcgtggttgttaccaaaaaatcaagtaccaagtggccgggaagcattgtcccaaatgcctttaaaggcatattctcacaaatgttcatctttcatgtacacttggctttaaaagaacacatcaaattttacatcaacataaaggtatgtgagtgatacacaaatgtgttcttgcacatcattataaggctattagtttgttctgtgcaagcatatacactaagcttaaatttatcttcttcaaaagccacctctgctcctgctatgaggttttagatcacccaagttgtacatttcctaaatccctcttcagttcccattcccatcctgtttttgtgtaaatccaagttttctcctaaaacttctggagcatctctagaagataagttctcccgacaattccaagaaacccacgagtaaggtacttaaatataacacatttatgagaagggttggcttgtcctctgtgcttttccttccttcctataaacatgtgcagacggcaggaaagtacccccgcctccacccctcaacagcgaagcttctgaagatcccgacggaaggcatggcagccatctccaatcattcttctgtttttgatgtgtggcttttgatgagagaacagtgatatgaacaccctttgcaccaaagtgacttgcttattttttttattaaatgatacattgaaagtataaaaagttgccgcagtacaaacaaattacagaataatgcatataaaagcgctatggactacacgtgacaattctgcttaacttccatcttgatgattttatatcagtatccaaaattatatactccagcattttttccgaatatagtcttacatgattgcaattcctgaggtaaactaagtgtccactgccaacatccttggacgaaaaccaagtcccccgggagaattcagatatttatattcacacatacaatacaacggaattcatcaatgtaatcagatattgcagatttaaaaatggaaaatggactcttgcaatacttctgcatccatatataattttaccagcagggcctcccaaaatgttgtgtaagtatagtttaaatggatttcattaataagtttctgcatttagataaaaattcttggctaatctgtaagaagtgaacactgactagcattgccaaacagaaaatcaaaagtttcaacaatttgcaaagcagcacagaattgacaccctaaagaggatgccaattttgctaactacagctcttaccactcttctccatggaaaacctttaagctaaatgttgtcagtgtttaggtgtgcaggcaaaatttaattctgaatataccatcgaacttttgccaatcaggagctgtctatcatcatagtcagttgttttcaatgaaatgagcctgtggacactacattaaaaatacttctttaataaatatcgaagtagcgtattagagatagcacatactatttttctatcccaagaataaaaattgatgtttggtaagagtttcggagcccaaacaagtagggggctggccctcttctggctcatctgtgattgcacaaccgagggccacacggagattaaacaatgccatctttgaaaaatccctttctggtatttctcccaaagcctgtctcttcatgcttacttcacattctttatctaataaaataaactctttgttttatttacagcaaaattattacagcaaatttacttctcctctaccttttaattaaatcttccagtaagccaaagtctaaggaaagaaaaagtacattgttgcctattgaaaaggtaatacaaagccctttcatttccttacaaactttaagggcctttataatacttcctaaatggctgggctcagtggctcacacctgtaatcccagcgctttgggaggctggggcacacagatcacctgaggtcaggagttcaagaccagcctggccagcatggtgaaaccccatctctactaaaaatacaaaaactactccggtgtggtggcacaggcctgttttcccagctacttgggaggctgaggcaggagaatcacttgaatccgggaggcagagattgcagtgagccgagatcgtgccactgcactccagtctgggtgacagagcgagactccatctcaaaaaaacaaaaaatacttcgtaaaaacaatactttttttttcaagtcaaatccaataagctagatgacaagagttagcttttattcacaaatgtagttaaacatgaggggtgttttgtagaaactccaatttctacaaacattagtggtgcattttggtaacattgggacaataaataagttatttaattaataatacaattttaagacaaaagataccccaaacaaagcattatctgttgactgcctgagaaacatgaagatcttcaatgttagtacttttctgttcctcctttcttaggtggtcatctgaaatgcacagaaaccaatgttaatacttatcccaagtcaaaacacacagataggtagacatagctacaaatatcttaggatgttacatatttaatattctatgagtactttagatggtttaggacaatgaaaaaaacccattattttttaaacactattgaagaaatcagaggccaagcgtggtggctcacgcctgtaatcccagtactttgggaggccgaggtgggtggatcacctgaggtcaagagttatagactagtctggccaacatggtgaaaccccgtgtctcctcaaaatacaaaaattacccgggcgtggtggcaggcgcctgtaatcccagctactcgggaggctgaggcaggagaattgcttgaacctgggaggcagaagttgcagtgagccaagatcgtgccatttcactccagcctgggcaacaagagtgaaactcggtctcaaaaaaaaaaaaaaaaaaaagaaagaaatcagaaatgtctggcattagggactctaattattcaaaagagtttcttgactttttttttgagtagagtacaacctgcagtaaacccatgcataagtagttacaaacctctctcttacatgtaaggaatgaaatttgcaagaaaggacaaggtgttcaatcagcattttgagggttgccaaagctcttcaattacaacacaatgaaaaccacttcaaatagatcacctgaggtcaggagatagagaccctgtctctactaaaaatataaaaattagccaggcgtggtggcgggcacctacaatcccagctacttgggaggctgagggcaggagaatcgcttgaactcagaagtggaggttgcagtgagccgagatcgtgccactgcactccagcctgggcgacagagcaagactcttgtctcgagaagaaaaaaaaagaacctagagacttaatatcctaatgcaacaaaaatgtaatgcaaaaactagattcttgagaatatatgaaccccaaacactttctacaactgataaaacatctttcttgcaacaactttgataataggaaaaaatatatacataaatttagataagctgctagaaaatgcaattttatcactgggttttctaattctacaatgtgattatacacacgctttattagttctcagctgcttattctcagtgccaatactactttaagggtctggaaaacagatggaaatctctctccctttattttaggtaactttgctggacagaaaaaaaattaacaatttcctcagaaggtaacaattttaggtcttctagaaaagtgttataaaaaatgaagtctactatgcttgatagatgtgcaataaagttaagctgatgactgtccctattataaaaatctggtctttcatttacaataaaaatcttcgccaggaatgtagtcccagctgtagtcccagctacttgggaggctgaggtgggaggatcacctgggcctgtgaggtcaaggctgcagagagccatgattgtgtcactgcactccagcctgggagacagagtgagaccctatctcttaaaaacaaaaaaaaaaagaaaaaaaatgtgtgtgtgtgtatatatatataaagttgaatagcaaaaactactttgccttcaagattacaagcactaacagcagcagtacaaatgcactggctgtcatttcaaaggtgggtgtgcctacataaaccctcttcattttttttcagcactgaaaacttggatgagagaagcactttttcatcttggcatgctttggacttacttctttctttccttttttttttttttttttgagacagagtctcgctctgtcgcccaggctggagtgtagtggcgcaatctcggctcactgcaacctccacctcctgggttcaagcgattttcctgcctcggcctcccgagtagctgggactacaggcgtacaccaccacgtccagctaatttttgtattttcagtagagacagggtttcaccatgttggctaggctggtctcgaactcctgacctcaagtgatctgcccacctaggcctcccaaggtgctgggattacaggggtgagctgccgtggcctggcctgaacttattttcaagtaaaagccaatttagtttcagggtttgatatttctgttgaatgagcttctgtggagacaaggtgctgtgatgtagaataaggattttagtatcttcataaccttttcaatgctgtcaaataagagttacggagacagtaagctagagttgaggaagtaaatggaaagcttaagtgtgttactgaaacatgatgcagttctggctgacaactttcaaggcactacacaaagaggttgtgtcaataaaatttttgatgaccaagaaaataatttgcaaaatcactgttcttccccgattcattcagcagtcatcctcatttctgagctgtctgcagagctttccacagaacaggcacccaaggtggctttactgacttgaactcgattctgatgttcctggcactttagtggtgtacaggtcgtgtgtctaggtgtctctttccctccctccctccataaatacctttctctctatggtgtatgcgtaatctaccgctttcatctcagaagaacagaaattggttaggaaatagtgttccttataactttcttactagtcatgagccgtgagtattaacaaggctgattatgaaacttacaaaccagaaagttatttctcaagcggttatttttctttatgggactgatagtatcaatgacttggggttgctgtgttaagaagtgttaaggtgtacaatatccactggtgacaactgaactcagaaactcatattgtcatatattcttggtaagtgtatagactgataaagcctttttggaggggaattagacaatatctactacatttttaaatatgcatatcctttgaaccaacaactctactttaggcatccacacaagagaaacgtgtagacaaagatacaatgttacatcacaatactgtaatgtgtggacaaagatacaatgttacatcacaataccgtaaaagcaaaatatttaaaactaaataagagtgattataaggtgggagagtagcctgggcaacaggacaagaccctgactgcaaaaaattaaaaaataagcgaggtgcagtggtgcacccctatagtcccggctacttgggatgctgatgtggaaagactgatcccaggagtttgaggctacagtgagctatgattgtgccactgcactccaacctggatgacagagtaagacctcatctctaaaattaaaaaaaggatgattgtaataatactctggaatatgaaacaaagttaaaaacgagatctacacgtatcaacaagtaaaaaaaagcaaattgcaggataacgtgcaccataacaatgtatatatatttaaatacacagaaatgagtcccgaaggggctgggcatggccagatgcagtggctcacacctgtaatcccagcactttgggaggccaaggggggtggattgcctgaggtcatgagttggagaccagcctggccaacacagtgaacctcatctctactaaaaatacaaaaattaggcgggtgtggtagcacatgcctgcagccccagctacttgggaggcaggagaatcacttgaacctgggaggcggaggttgcagtgaggtgagattgtgccattgcactccagcctgggtgacagagtgacagtccatctaaaatttaaataataataataaaataaaataaaataaataaaataaaatagaaatgagtcccaaagaataccctgcaaactgctaacagggacaccttctataaaaagggagaagaattgaggagttagggagaggcaagaaggaagaaaggaaagttaaagggaactttttactatttaaaaaatttagagatttactcatgtacttgcactattaatgttttattttgctcgttaagtacttgccaattagtaggcagtaatgtcagttccttaccaatccctaaaaagagaatttggaaaacttctccataatctatatgtggaaaggtatacgggaacagcaatcaaatgtgctgattctgctactaattatctgctacaggtcttagttgagttacttaacctcttagtattggaaccttcttaaagttttctcaactatgaaataagtagatgggaatgacttattttccaacgttccatccagttcagcattctaatatatatagaaagatatctcctagtgcagtcagaaaccacctccaaaataggttatcctgattcactgtttactttcagacctcaagagacaccaagcatctaacacggtcactactggtcatagcagtttaggaaactacaaaggcaatccacattttaggcgtttcctaaaagtttcctaaaagttcgtgtcaacattcaagatttacatttgttctgataattggcagcctaaaccccacctttaactgtccttaaaaattgaccagctcttggttgggcgcggtggctcaagcctgtaatcccagcactttgggaggccaaggtgggcggatcatgaggtcaggagatcaagaccatcctggctaacacagggaaaccctgtctccactaaagatacaaaaaattagccgagtgtggtgatgggcgcctgtagtcccagctacttgggaggctgaggcaggggaatggcatgaacccaggaggcagagcttacagtgagacgagatcacaccactacactctagcctgggcgacagagcgagactctgtctcaaaaaaaaaaaaaaattgatcagctctctaccacaactgaaaacactgagctataacccactcaattcaaatggtgaaaatgggatcccattgctgggataatcaaaataagtcagggccaggtacaggctcgtgcctgtaacccccacactctgagaggctgaggtgggaaatcacttaagaccgagttcaagaccagcctagtgaacacggttgagacttccatgtccacaaaaattaaaaaattagctgggtgtggtgcctgaagtcctagctacttgggaagctgaggcaagaaggtgagaggattgcttgagcccggcagttcaaggttacggtgagctataatagcaccactgcactctagtcaggcgacagagtgactagaaaaaatacataaaaatttatgtatttttatgtctcaaaaaaatacataaaaatttatgtatttttatgtctcaaaaaaatacataaaaatttaaaagctaccaaaagctcatttaaaaaacaggcaatctgaaagaaatgtgggcgattctcctaacaatctgtaacttgtaggtaacttccactgtaacataaacagtatcctaaaaatgcaaatgacttctctatctgtatttagcaatcttaccttttattttgcagtcatggagaggaaaaaaaataatcacttgataaaaagctatttattcagtataccaaggatctaagctgctccaaatacttacaatttacatgaaaattggagttttcagtatttttttgtttttttttaaatttaattaatataattttttaattaaaaaaatagagatggggtttcaccatgtcacttaggctagtctcaaactcctggcctcaagcgatccacctgcctcggcctcccaaactgctgggattacaggcatgagccattgtgcctagcccagagttttaaatacttctataaagaaattacatctaagaattctgcccagttatgcctcccacccttccctgtccaagattctttacaaaaagcattctgtttcttggagtaacataggctagacatattagatataagcagaattaaactatgactcaaaagctcagtaaagactccaaaagaaaaatatataggaagaaaacatatttgctgacagctaaatgatgaatcttggaaaactcatacccattggctttcttctactaggttgtctgccaagacttgggtctgaaggctgaagtgaaggccctttcagaaatgcattctggatgccatccttagttccacgcaagaaatgggctaaaatcccatataaaagaggtctatagcaggaagaaaacaaaacaaaaccaaaagctaataaatctgcataaacgggaaaagcttaaaacatttattctttaaaaggtaacctctgacatcaaaaagaccaagtgattcactagactttaaaaagcggcatgattatccaaaatgcaaattgttcatacttttaaatttaagagtaccacttaatttcatgacaattttaaaacccagagaaaacatgttaacaacttaaacctcatctacactgaaatatcatttctatcaatccacaggaatctcttttaaactccaaagtccagtagagtatttcccaatacctaaccccatctaatacacaacaggtattcaataaacacctcttgattaataagtccttgccctgaaaaagtcttaggtcctgagagccaggtgacctgagttcaaattctggctttgccatttgctagctgtgggactctgtgtaagattcttaacctctccagcctcataaatgtttcttcctttataaattaggataagcaccgtccctcccttatagggctgttatgcactaaatgagttaataaatgtcaagtgttttttactgtgcctggcacatatgaaatggtatataaatgttagctcctgtgtagctaacatttatttagattaatatttacattacctattattttaaaatcttctttatagtttacagaacgtatacctcttctcatctaatcctcatcgtgtaatgtcaagatcatcaactgcaatttataaaggagaaaaccacagccaggagatttgctagagattcccccagatagtaaacaaagtttacacttgaaccccaaatcccatattgttttccttacagtgtgctgcctgggaatttatattagtactcttgcatcaaggaaagctgctctgctgacaatcaagagtggtacaatggaaatgttttcctttgtttccaatctcaaatttgaaaacacaattaaaaggatttaatctttatttttaatttttgtgggtacatagtaggtgtatatatttgtggggaggatttattttttgagatatgtatctatttactagctggtataatggtttacagtacgacgctcccttccaaagatggaatctcattgccctctgagtgtgagctgaactcacttctaactggcacaaagctgacttcagaggccacgtggtaatggccctgcagcttcctccttgctttctctcttggattgctgcctttgggagaagtcagatgcctcaggacacttcagcagccctggaaagttacatgcagtaaggaattgaggccgcctgtcaatatcattatgagtttggaagcagatagttcagccacattcaaggcttccgactacaaccctggctggcatcttgactccaacctcaagggggagcctgagctagacttacgtgactaagccaatcccaaatccccgaatattccacaaataatctatgttgttgttctaagctaccaaattctggaataatatcacactaatttttccatgccacagggaaaccaggaaagtaagtttctttatttaataagatgccgcaactcttatgaaagcgtcacctagtaatataaaacaggtctctttgtttactttaatcttccccaaagtgttaactggttcaagatgatttttaaatgttaaaagttttattttttaaataaatattcaaaaaaatgtacttgtgattaaaattttgggttggacatgggggctcaggcctgtaatcccaggactttggggggccagcctggcctcaaacaggagtttgagacagcctgaacaacatagcgagtcccctagctctacagcaattttattttaaattagccacagaaggtaatatgcacctgtggtcccagctacttgggaggctgaggtgagaggatcgcttgagtgcagaagggagaggcaacttgcaaattcatggattaaggtttatcttttaaaataagtttcaaaaagataaagaaaagtgcggcctcacaataacttgcctgtaattctgaaatgcaaaattctgaaaactggattctcttcatatatctggcaaaaaatcatcagatggcaagggttgacctaacaaggctattaacaaggctattacagactttatcttactttgtgtgaaaacattaatgtgctgggtgtggtggctcaagcctgtaatcccagcactttgggaggccaaggcaggaggatcacctgaggtcgggagttcaagaccagcctgaccaacatggagaaaccccgtatctactaaaaatacaaaattagccgggtgtggtggcatgctcctgtaatcccagctactcaggaggctgaggcagaagagtcacttgaacccaagaggcagaggttgcagtgagctgagatcatgtcattgcactcaaaaaaaaaaaaaaagagaaagaaaatattaatgtgattgtggaatactactttaggactccctggcacatacatgtagtatttggtagatgtaccatattactttttttttttttttaaagaattgaagtcttgggccgatggctcacacctgtaatcctagcactttgggaggccgaggcaggaggatcatgaggtcaggagatcgagaccatcctggctaacacggtgaaaccgtctctactaaaaatacaaaaaattagccaggcgtggtggcatgcgtctatagtcccagctacttgggaggctgaggcaggagaatcgcttgaacctgggaggcggcagttgccgtgagccgagatcacgccactgcactccagcctggacgacagagtgagactctgtctcgaaaaaaaaaaaaagaactctcgctgtgtggcccacactggagtgcagcagcaagatcatggctcactgcagcctcaatctcctggatttaagtaatcttcttgcctcaccctcctaagtagctaggactacaggcatgtcattttaaaacccgacagcatttggattttcaaacatgtatctggcctcagtggtttcagatgcagcactgcagatctgtaagtaaataatatgagtaatatgtgactatggcaaactctgtgaatgccaatcactgaagtgtgagaaacaagggcttaaagaagttacctaacttttaaaaaataaagccgttttagcaacttttttttttgcttcctcatcctctctcaaacttacttttttttttttttttggaaacggagtctcgcttctgtcgcccaggctgagtgcagtggcacgatctcggctcactgcaagctccacctccccgtttgacgcccattttcctgcctcggcctcccaagtagctgggactacaggcatccgccaccttgcccggctaattttttgtatgtttagcagagacggggtttcaccgtgttagccaggatggtctccatttcctaacctcgtgatctgcccgcctcggcctcccaaagtgctgagattacaggcgtgagccaatgcgcccggccttcttttttaaaaaaatatcaaacatttcacgaatttgcgtgtcatccctttgccggggccatgctaatctctgtaccgctccaattttagtttatgtgctgttaaagtgagcacaaacttcttaatactttcatctgaagtaggtatctcaaaagctaccaagaagccagtaatagtcattgcttatttccatcaactgctaaatgtaaaatgatgtcttgtattaaatgatgtaataactcactgctcatcctaagtcacgcttagattcccccaattatttttcccactgttctcaattatacaatttttatacttttcaaaacacttgttaccaggtgcagtggctcatgcctgtaatcccaacactttggaaggccaaggtaggtggataacttgagctgaggaattggagaccagcctggctaacatggtaaaacaccatttctaaaaaaaatacaaaaattggccaggcatgatggtgcatgccagcgtatgcctgtaattccagctacatgggaggctgaggtgggagaatcgcttgagcccaggagttcgaggctgcagtgagccatgatcaagccgctgcactctagagacctgggcaacagagtgaaaccctgccttgaaaaaacaaacaaaaaaacctcacagcactttgggaggtggaggtgggcagatcacttgaggccaggagttcgagaccggcctggccaacatggtgaaaccccatctctacaaaaaaatatgaaaaaaaattagctgggcatggtggtgcacacctgtaatcccagctactcaggaggctgaggcagaatcagttgaacccaggaggagattgcggtgagctgagatggggccactgcactccagcatgggcgacagagcgagaccctatctcacaaaaaggaaaaaagaaaaaaaaaagaaacaagggaagatgagaggaagagaaagaggaaaatgccataaaggagttactatctgaacagggccaacagaaaggaaagatgctccaatagaagttaagatgctccaatagaagagggagaaaggtgatgtagggcttctaggataagggaatggtttacaaggcaaagcagcataaagttgcaaagtgtcttccaggcataatcagaaatcaggtgtgagcagatagaacaacagacgggtagaaagaggtgtaaagtgctacgctaagcaacagggacttcactatacacacaatgacaaaggtagtatatgatcctggaacattaattttacacaaggatttgtgggagagttagatttaactggaatgtcatttaaaacatttatatagtaaagcaaacaactttcagaacttttttttttttttttgagacagggtctgattctgtcacctaggctagagtgcagtggtgtgatcttggctcactgcaacctccgctgcccaggttaaagcgattctcatgcctgagcctccctagcagctgggactacaggcacacgccaccatgccttgctaatctttttgttatttttagtagagatggggtttcgccatgttgaccaggctggtctcaaactcctgacctcaggtgatccacttgcctcagcctctgaagtgctgggactacaggcatgagccaccacgtctggctagagatggggtttccccatgttgtccaggctagtcttgaactcctgagctcaagtgatccttccacttcagccttccaaagtgctggcattacaggcacgagatacctcacttggccttaagaacttttaggatgagaaaacgtaaggcttcaaagaaagttctagatttaaaaaaaggctgctttaagctatgttctcaggtctcctatgtacttttttttttttttttggctatacagggactctccagaaaaagtttaagaaacactgaaatagaaaaaaactaagaaaactagaaagtggtcatcctccttttcaagagcatagttggtgagaggaggtacacagagggcaaaggacagagtaatagtaacgaaagcagtgggctgattcagtaatcttggtagaaaaaggtattcgagcagaagcttggggttggaagttcatagtttttgtttttgtttttgtttttgttttaggagaggagagatctgagtacattcctaagttggagtgaaggaagagttaaatatgaagaaaacaactgacaaggcaaagtctcagaggccaggcatggagggctcacacctgcaaccctagcactttgggaggccaaggcaggaagatcacttgaggtcaggagttcgagaccagcctgggcaaaaaagcgaggccttgcctctacaaaaataatttgaaaatacaaataaaagttgaaattataaattaaaaaacaaacaaagccttagaaggacaaaggatcaagaagtcaaaaggagctaactccagaaagaagatgctgagtcactctgaagccatgtaattgtagcttcagcaaacacagatctcatctgacttattcactgctgcacaccctggatttaggacaatgcttgacacacactagatctgaataaatacttgaattaaaatgaagtaaaaccaccatggtgcaattatgactcaatacaatatgtggaaacttctttaaaaaaatgtcttacattgtattatcctttgattcttcaaatgcatttagttcatggatgagaaactgtctgtccaacggaactacaggttgaccagattctgggagaaataaattcatgagaacactcagtctattaaactaaaaagcaaataagattttgaaaagaatcacatttaccagacatacactttttagattttggaagaatgatgacaacacacaccaagacagatcaaattgcctgtgattttatgactttcaaaatatctcttttgttaaatgcatgtcttaatacagtttaacataaattcactttttaaattccccagtgtttggttggaaaaataccatttctatatccaaattataatactaaattttggaagtctgtttatcaataacttatttttgaaaagaatatccacttggtgacaatacttataaataaaaattaaagttaacctgaagtgtggggcagctggaactttcacactttgctggtgggaaagcacaatggtacaggcactttggaaaacagttgagcagttttcttataaaggtgagcgtgcacttaaccacacaacccagcaatctcactcttagctttctacccaagattaatgaaaacttatgttctcacaaaaacctgtatgtaaatgtttatggcagcttgattcctaactgctaaaactagaaacaactcaatgcccatcaactggtcatagatgagcaaactagcacagccacacaatagaacagtgttcaaaggaaaaacaaacatggctgaatcttgaatgtattacactaagtgaaaaaaggcagactcaaaaggctacatcatgtacggttccatctacagcaagggtccccaacccccgagccacagattagaaactgggccacacagcaggaggtgaggagtgggcaagcaagtgagggaagcttgatctgtgtttacagctgctgcccatcactagcatcactgcctgagctcagcctcctgttggcagaattagattctcatagaagcgtgaaccctattgtgaactgcacatgcgagggatctgggctgtgcactccttatgagaatctaaggcctgatgatctctcactgcctcccatcacccccagatgggaccatctagttgcaggaaaacaggcttagggctcccactgattctacattatggtgagttataattatttcattatatattacaacacaatcatagaaataaaatgcacaataaatggagtatgcttgaatcatcccgaaccatcctcccaggtccatggaaaaattgtcttccatgaaaccagtccctggtgccaaaaaggctggtgatatcttgattgtgatctggtagtaattacacaactgcaggcatttgactaaagtacagaactgtacagtttaaaaggtaaattttattgtatgtaaattatatcccagttttttaaaaaaagccaaaccatttaatatgaaaacttgactactgtcactatatttcattctagtgaatcccaagtccccactattttcataatttcttcttttctgggtgtaactggtatcatacagccatctataacaaacaaaggaaagcagagatgctgatatcaaagatccttaaaccataaaaatcatgagtctttatgtagttcagacgtatgtttaatattaaataaaggatctgtaacgaaaaattctaacttcacaaagaattcattctctcttgcaaaatctacttcctggcctcgcttctttgctgaggcatgaagtagtcaaagcagagatggaacctgaaacgagggaatccgatgacacacattcagggtgcctcagaccaacccccagctgcatcccccaccccaccaagtccaggggtaaccaggattctgacttatttatatccatccagtctctcctcacttttttgaaagaagacatttaaaagtcagcagaagatattaaaaatattctcaccactcaataactgttacacttgaagagcaaatttatttctcaagaaataaaattcaacagataaagggaatttatctttatctccccacccccaacccccaatatcattctctgcctcctatcactaggatgagtttggagtttcccgctgctagagtctggatatttgtctccgcccaaatctcatgttgcaacgcactccccagtgttggaagtgggacctggcgggagttgtttgggtcatgggggtggatccctcatggcctggtgctgtccttaccacagtgagtgggttctcatgagaacaggtcatttataagtgtgtggcactaaccttccccacccttggcccctgccttcaccatgtaacgtgcttgctgcagtgagcaaaagctccctgaggcctcccagaagctaagcagatgccagtgccatgcttgtacagtctgcagaaccgtgagccaagtaaacctcttttcttcaaccgggtgcggtggctcacgcctgtaatcccaacattttgggaggccgaggagggcggatcacgaggtcaggagactgagaccatcctggctaacggtgaaaccctgtctctactaaaaatacaaaaaattagctgggcatggcctgtagtcccagctacttgggaggctgaggcaggagaatcacttgaacccaggaggtagacgttgcagtgagccgagatcaatccacactccagcctgggtgacagagcaagactctgtctcaaaacaaacaaacaaacaaacaaacatacaaaaaaacctcttctcttcataaattacccagtctcaggtgtttatttatagcaatccaaaaacaacctaatataccagcctagtcctttataaataccatgcttttagatacatacatttgtaaatgtacctaagcactacatagtagtaatatttcaaagttttatctccattatatctatctatctatctatctatctatctatctatctatctatctatctagatacacacacacacacacacaaatagacatatatctacatatctatatatagacagggacagttttttttcttttaagagacaggagttggaccagcctgtccaatatagtgaaaccccgtctctactaaaaaatacaaaaattcgccgggcctggcagcacacacctgtagttccaggtactcgggaggctgaggcaggagaactgcttgaacccaggaggcggaggatgcagtgagctgagatcacaatagagtgagactccgtctcaaaaaaaaagaaagaaaaaaaagacaggggttgggtgcagtggctcatgcctgtaatcccagcatttggggagtgtgagataggtggatcacctgagcccaggagttcaataccaggctgggcaacatagtgagagctcatctctataaataataaaaaaatttagctgggcatggaggcatgcacctgtggtcccagctactcaggagactgacgcaggaagactgcttgagcccaggaggtgaaagttgcaataagccatgatcgcaccactgcagtccagcctttgcaacagagtgagattctgtctctggaaaaagaaaaaagagacagggtctctctctgttgcccagactggagtgcagtgatgcgatcatggctcactaaagcccagagcacatgggctcacatgatcaccccctccccgacccctgctcagcctcagctaggacaacagacacgtgccaccatgcatggctaattttaaaaactcttttccagagatggggtctccctgtgttgcccaggctggtcgcgaactcctgggctcaagtaatcttgcctcggcctcccaaagcactgagattacaggtgtgagccacctacccagcctattttttaacaaataatatacttaatcagcgtatatttttaaagcttaatacacaggaaaaaactggtggcaaacaggacaaaacgtcaacaattgtttattctcggttacaggaattatagatgatttttccaagtatatgcctagtttaagtgattatttagttatgtattttctcttgtaagaatctgtttaagctacagaaagaacccatgtgatttttgtgtcccagtcacccagatggcactatctggtaagggaattagatttctaggataaacagtttctgagaattggggaaaggggagaaacagattttatgtgataaataataaccacttacctgctatgaggacagatgctgtatacttatatttgttgaattctaaatactctcgaattaattcattaattagaaggttttcatgagacaatgatggtcggggttcacggtcatcatctagggcattgaaaacttcagctcggatccttgcttttaaatgccctaataccccctttttttccaaggtgtcctttaaaactgttcgatataaaatattaaggcttcagttacagagtaaatttgtcattcttaggcatactttgaaaagaaatgttgaaaaggtaaatggtacaaaaacagctctcaagcagctcttaatctaaacattgtgacaaattattaaacaattacactaccaccagccatgtttatactaaaacatatagttctcatgttgcagtgatttagtcttaatatatttgagcaaattcaagtttattcctacatcatcagcactgtcaggggctgtagtctaatacatattcttttttattttatttattattttttttgagacacagtctcgctctttcacccaggctggagtgcagtggcacgatctcagctcactgcaacctctgcctcccaggttcaagcaattctcctgcctcagcctccagggtagttgggactacaggcacgtgccaccacgcccaactatttcttttttgtatttttagtagagacggggtttcactgtgttggccaggatggtctcaatctcctgacctcgtgatccacccacctcagcctcccaaagtgttgggattacaggtgtcagccaccgtgcccggccaatacataattctttagtgaggggaaaaggcgggggataggattatagttgcttactgagacctgaacttaagccccagtctctcatatattttcaagagtgtctgccactgcacacaggttctgcttgtcactaacaacctctggtctagaaagatgattaaagaaaacaactacattccataaaagaagtctgttgggttactgtgtaaaaaccttgatggcagggcatggtggctcatgcctgtaacccagcactttgggaggctcaggcgggcggatcacgagatcagcaaattgagaccatcttggctaacaaggtgaaatccccctctctactaaaaaaatacaaaaaattagccgggtgtggtggcacgcacctgtagtcccagcaacttgggaggctgaggcacaagaattacttgaacctgggaggtggagggtgcagtgagctgaggtggtgccactgcactctagcctgggcgaaagagtgagactctgtttaaaacaaccaaccaaccaaccaaccaaaaaaaaaaacacaaacctttgataatccacaacgctttagggagtgaaaaggtgttgggtttttcattgttgttattttgaaacaatctcgctctgtcgccaggttggagtgcagtggcacgatctcggctcactgcaatctccaggctccctggttcaagcaattctcctgcctcagcctcccaaatagctgggattacaggtgtgcgataccacgactggctaatttttgtatttttagtagagacagggtttcactatgttggccaggatggtctccatctcctgacctcgtgatccacccgcctcagcctcccaaagtactgggattacaggcatgagccactgcgcccactggcctcgttgttttaaagacaactatgagttaattccttagaacagtaggattctgaaattttaagcctagttagaaatctaccacgtgactgtatcaatgccatcttaaggagtcagggatgtgtatgcagaatggaaatctaacttactgattagccagagtcaccatgacaaagcagttatgatcatgggatttggctgtacatacttagtatagataatggggatcttaggactgaattggcaccatcccttgtagtgatctgcaacttttattttcaaacagttcctactggctaaatgacaacttcagagaatgaacacatctcatccacagagtcaagaacagagcaagagctcagtaggtgtcacctagaaggattataatacattgctgtacactactgggaaatcaatgtagtttaacactgttctgcaccctgccaaaggcaccaagtaagtacatcacaataacaaaaatccataaagagagcccaggagcttatccaagtcagtatggacataagatctttctaagcttcaataaataacgtcaacaataaccctggatcatatgactaaagagatagaatcttcactgacttttgacctttctttcccctcatttttaaagcatcccttcaaccttcttgcagataggttaagtacagttatcaccagatcagagtttgtaacaggtccataaaaggaaggtacagccttattgtactcttagaatcataactgaacccctattctctaattccatctttggaaattggatggagagattttgtcactggcaaggatcctgtcccaattactctgtattgcacacaggacagcctcaaactggacagagaaacgagaattagtgacagtggaatgaggaaagctagcatgtctcatcagcacctcagtggtggattaccaacccatgcctcagttgccttctctaaaataatgagctctacctctcagagatagaaccaagtaagaaggaaaaacgtgatcgtgcttaaaaaaggtaaatgcccataaaatgtaaggtaactggctggcaaacaagttttcaccgggtttcttttggaggtccatagcattttacctttccctctattatgcttagaacactgcgccatcaaaacttcttcggaaaggtcttaacctcgcttatatttcaagagtaccttttttattttattttttaatttgtttttttttttgagacaaggtctcattttgttgcccaggctggagtgcagtggcaccactgtagctcattgtcacctctatctcctgggctcaagctatcttcctgtttcagcctgtggggtagctggaactaccacaggccactatgcccggctcttttttttaatttttattttttaaataaagatggggtctcaccatgttggccaggctggtcttaaacttctgggctcaagcgatcctcccaaagtgttaggattacaggcatgagccactgtgcttggcccattccaagtgtacctttaaatcctctgaaaatgtatgcaatattacatgtgatgtgtatttccctgggaacagcatctgtagactcgtgaagtctgttcttgtggacagatgcatgcctgttctgttttatgattgttcaccagccctgtccccaaatacacacttttatacacgtctcctccctaaaatatctaagaattactagtttaaaccctgggttccctgcaaagtggaactggttttattttttggacagcaatcttgctcagtgattaagacctggcgctccagtgcgtcacaactaggttcccatgctgtgtctctttccagtgaaatcactttgagctatttcacttctcagtacctcgtttcccagtctatgaaatgggcatagggttgttacaatcaggtaacacacaggctgagttgagtagtgcctgacacatgaggctcaatgataactattattactattacttgtctggacatttgcttcaaagtaaacagcgtacaaatgtcattaatgactcaaacataactagcttagagtatcttttcctgaaaagacaggagaatggccaggccagcaaactttttgcctctagtttcttctgatgaaaaaggggccaggcgctcacacctgtaatcccagcactttgagggggccaaggcaggaggatagcttgagaccaggagttcgacagtaagaccccgtgtctacaaaaaatacaaaaattagccgggcgtagtgaagagcccctgtattcccacctgctctggaagctgaggtgggaggatagctggagtcccggagttcgaagctgcagtgagctgtgatcgcgctactgcactccagcctgggcgacagagagaccctctctttaaaaaaaaaaaaaaaaagcaaggaggggagggctacttaacaggttgttgtaaggacccaacgagacaaccaagcaaattgtttagggcagtgcctaacccaataggggttgtgggaattgtagtcatcagccctgagtgccaagcctggtccaagtcctccagcccccggcagggtccaagaagatgagccaggggcccaagatgcaggcctgtaggcctcttagatgcctgaagattacgcaactcctcctttagctccaaactggcttaaaactcgccagtgggcaacctcttccccataagagctccccgcgcacgggccaagacagcagccagacgctccccgcaggccctcacaccgaagaatgacgcctgtaaaagccaacccatgtgttccgcgcgctctcctcccatcccatcctttccacaagatgaaggcccgacgcttcccatgtggaggcctccctgctcgcactcaccagccttcaactctgccacagtcgccatttttcaacggccgccagggccgcaccgcggccctgcgcacgcgcagctccgccccactcaccctgcggcgtggtctgtagccaataggcgcacagctctcgccccgcccacttccgcccctctcagtttatgagctctgcggttgagtgggtagtgaatgtcgaccagagactccaccaatcagcgagcgctctcggaaggcccagttgagtgagacggcagggagggcggggactgaggcagtggagagccctgtggggtgctgctggcaccttagtgcttaactttagccagctgagtttttcattgtctctgcagcctcaagtaccaactgctagtagttaccacctattaaccctgcggttctcaaacttgagcatgaatcctcatcacctccaagacttgtttaaacggattgtttgctagtcctccccatagagtttctgattctgtaaatctggggtgaggccctaggatttgcatttctatcgagttcccaggtggtactggtactgctggtcggtctggagatcacacctcgagaaccactgtattaagcacttactgtgacgccttagcgcattatttccttatgatcacgccgtttttacaatgaaggaaacagagtcctccatcgctgaagagacttaaccaaggtcaccagcctgtcctcttccactcgcacttacacagtgcatgtaaggagtccaggagctttttatggaactaactaatgaaggaataagctccaacatcccatggaagtaaaggaaaaggaacaggggaataatgtaccctaaactgagtgtgaggttgcatgattccagttgtaatgccggtgagatccaaacacttggctaaataataaacatcgattagacgtacacctaagagtggccgggcgcggtggctcacgcctgtaatcccagcactttgggaggccgaggcgggcggatcccgaggtcaggagatcgagaccatcctggctaacacggtgaaaccctgtctctactaaaaatacaaaaaattagccgggcgtgctggcgggcgcctgtactcccagctactcgggaggctgaggcaggagaatggcgtgaacccgggaggtggagcttgcagtgagccgagatggcaccactgcactccagcctgggcgacagagtgagactccgtctcaaaaaaaaaaaaaaaaaagtacacctaagagctgccagggcacggtggtttacgcctggaatcccagcactttgggagactgaggtaaggagttcgagaacagcctggccagcctggtgaaaccccctctgtactaaaaaaaaagtacaaaaattagccgggcgtggtagcaggagcctgtaatcccagctacttgggaggctgaggcacaagaatcgcttgaacctgggaggcagaggttgcagtgagatgagatcgcgctactgcactccaacctggacgacagagcgagacaccgcctcaaaaaaaaaaaaaaaaaaaaaccacctaagagcaaggaaacctctttccgaggaacttccagcatacttttggttccatgcctattgtttttaaaactgatacattggccaggtgcggtggctcatccctgtaatcccagcactttgggaggacgaggagggaggattgcttaagctcgggagtttgagatcagcctgggcaatgcaagaccccatctctccaaaataaatacaaaaaattagccgggcatggtggtgcatgcctgtagtcccagttactccagaggccgaggatagaggattgcttgagctcaggagttctagaccaagctgggcaacatgagacgcatttctacaaaaaaaaaaaaaaattagccagatatgatggtgcatgccagctactcgagaggctgaggagagaggatcacttgagcctggacggctgattgtaccactgcactccactctgggcgacagagtgagtccctttctcaaaaaaaaaaaaaaaaaaaaaaaaaaaagaaaagaaaaagagagaaagaaaaattgatatatcacaattatggggagggacgtgatattttgatacacatatacaatgtgtaattatcaagtcaaggcaattgggataaacatcacctcaaacattctttgtgttggaagcattacaagtattctagctattttgaaatatacaatcaataattgttaactattttttttaaagggagggggaacagcctgggcagcatagggagaacctgtctttaaaaacgagcaaacaaggccgggtgcggtggttcacgcttgtaatcccagcactttgggaggcctgaggcaggcagatcacaaggtcaggaattcgagaccagcctggccaacacagtgaaaccccatctctactaaaaatacaaaaattagccgggcgtggtggcagaggcctgtaatcccagctattcgggaggctgaggcaggaaaattgcttgaacccaggaggcagaggttgcagtgagccaggggtgcagaggttgcactccagcctggggaacagagtaagactccgactcaaaacaaaacaaaacaaaacaaaagagcaaacagccaggcacggtggctcacgcttgtaatcccagcactttgggaggccgaggagggcagatcacctgaggtcaggagtttgagaccagcctggccgacatggtgaaaccccatttctaccaaaaatacaaaaattagctgggcatggtggcaggcatctgtaatcccagctactcgggaggctgaggcaggagaatcgtttgaacctgggaggtggaggttgcagtgagccgagatcacgccgctgtgctccagcctgggcgacaagagtgaaactccgtgtcaaaaaaaaccaaaacgaacaaacaaacaaaaaaaccgagcaaacaaaacaaaaaattagcctggcatgtgtccctgtagtccgagctactcgggaggctgaggcaggaggattgcttgagcctaggaggtggaggctacagtgagccatgaccataacactgcatttctagcctggtgacaaggggagatgccttttctttcccttccttccttccttccttccttctttccttccttcctttcctccctcctctctctctccttccttccttcctccccgccctttccctttccttccttccttccctccctccctccctctttctctctttctctttctttctttctttcttttctttctttctttctctctctctttcctctttctctcttactttttcttgagacttaaaaaaaaaggggggccaggcagagtatcttgacctagagtctaggataatgctctttaaactgctggttaaccaaatagtaggttttgaaatctatttattagtagatccccatgagtacattttcagtgaaatggaatgtaacaaatagaaaacatagaagtatggttttctagaactttcctttcaggtacacatgtgtgttctggtacctgttgtatttcttaaagtgatcagccatcagaaaagtttgaaagtgattgtaacctagaggaatctcttcctattccaaactggattaatttttgactggattaatttttgattatgggacacatatctgttctgtaaccttgaaaaggtcctatcttgtttctctactctgtaaaaccacagtgactgaatacctggccagcatttcaagagatttttggggattaactaaattccataggtggtatttttaagtccctcagaaaaagcactcctgtggtgttatgatataggtattgattttcatctccacgattcctggcatctaactcccattcacctcattataatgttgaggcactttaggcctcaggaaacagaatctccctctctgatcttctcctgtccacctctgacctgccccaagcaggactctaatctgactgtgggtcaaaagaccctcattccagaaagggttctgcctgctaccctcaaggaagaaatgctgcacagagagcccaagaaaagtctgagcagacaggctttgctgggtttagatcaggcactttctgtccaatcagatttctttcttttttttttttttttttgagacggagtcttgctctgtcgcccaggctggagtgcagtggtacagtctccgttcactgcaacctctccctcctgggttcaagcgattctcctgtctcaaccacccaagtagctgggattacaggtgtgcaccaccatgcctggctaatttttttttttttccagacagagttccgctcttgttgcccaggttggagtgcaatggcacgatctcggttcacctcaacctctgcttcccgggctcaagcaattctcctgcctcagcctcccaagtagctgggattacaggcatgtacaaccacacctggctaattttgtatttttagtagagatggggtttctccatgttagtcaggctggtgtcgaactcccgacctcaggtgatccgcccacctcggcctcccaaagtgctgggattacaggcgtgagccaccacgtctggcctgtccaatcacatttctacacggtgttcaatcacacctatgtaataaagtgtcccataaaaacccaagagaactgggttgggagaacttctggatagcagaacacgtggaggttgttgaagggtgttgcattcagggaaagcatggaagctccacaccccttcccctatactttgccctatgtgtcacttcatctgtataaacaaaattaagtgtttccctgaattctttgagccactccagcaaattaatggaacccaaaatgggggttgtggaagctccaacttgaaggcggtccatcagaagtttcagaggcccaaacttgcgactggtgtctgaaggaaggcagtcttggggactgagctatcaccctgtgggaaatgacactattttcaggtcgaagatgtcagatttaaactgaaggacacccagctggcgtcagctgcagaactgattgtttgctggccaggcgcaatggctgaagtctgtaatcccagcattttgggaggcagaggtgggtggatcacttgaggtcaagagttccacactagcctggtgacatggtgaaaccttgtctccactaaaaatacaaaaaatagctgggtgtggtggcatgcacctgtaatcccagctactcaagaggctgagccaggagaatcgcttgaacctgggaagcagaggttgcagtgagcagagatcatgctatgggtgacagagtgaggctaaacctaaaaaaaaagattgtatgcttgctggtggggggatttccccacacatttctggggtccacagaagtattctgtgttgattattggtgtgttgatgtgtgagcagagaaaaaacacggtttgagaaagtttatatccaaaaaactcctgaatatgttgatgaggaactcggagagagaggcaaataataatgtgattgaccgattggcagtggtaatcatacagtagctaacattcattatactctctgtatggcaaggactgctctaaaagctttacattaagtattcaccaacaaccctatgagatggatacttacatgcaattgtctcaagtaaaattgtatttaaaaacatactggccaggtgtggtggctcatggctgtcatcccagcactttgggaggctgagacaggcggattgcttgaggccaggaggagttcaagacgagcttggtcaacatagtgaaaccctgtctctactaaaaatacaaaaaattatttgggtgtggtggcacacacctgtaatcccagctacttgggaggctgtggcatgagaatcacttgaacccgggaggcagaggtttcagtgagctgagaatgcgccactgcactccaacctgggcgacagagaaagactctgtctcacaaacaaacaaaaaacatgtactaatgaccaggcacagcagttcatgcctgtaatcccagcactttgagaggctgaagcgagaggatcagttgaagccaggagtttgagaccagccaagccaacaaatcaagaacccatgtctttaaaaaaaaaaaaagtagctgggcatggtggcacatgcctgtattcctagctgctcaggaggctgaggcaggtggattgcttgagtccaggagttcaaggctgtagtgagctatgactgtaccagtggactccagcctgggcagcagagcaagaccccatctctgaaaaaataaatacctttatacatacattaaaaacatgcactgacattgagtaacactgaattgctggggatatgtcgaaacaggcactgccatacatagttggtaggtaggcaatcaacaccaccatccagaaggcagtttgtcaatatctcatcagattttcacaccctttgactcatcaaatctacttctaagaatgtatcttacagatataatcacacctacttacaaaggatataagtataagaatattcattcactgttgatagtagaaaaaactatgcacacctttcagaaaggctaaaataaagactactgacaatactgttggcaaacacacatgtactactggtgggaagacaaagtggtatagtcactttggaaagcagtttggcaattgcttattaagtcataggtacacttggcccagtaatcccaaaactaagtgtttgcccaagtgaagtaaaaacttgtaggccgggcgcggtggctcacgtctgtaatcccagcactttggggggccaaggcgcatggatcatttgaggtcaggagtttgagatcagcctgagcaacatggtgaaaccccgtctctactaaaaatataaaaattagccaggcatgatggagcatgcctataatcccagctacccaggaaaattagccaggtgtggtggagggtgcctgtaatcccagctacccaggaggctgaggcaggagaatcacttgaacccgggcagcagaggttgcagtgagccgagatcgtttcactgcactccagcctgggcaacaagagctaaagtccacctcacacacacaaaaaaaagaacttgtagccaggcacagtggcttatgcctataatccccacagtttatgaggccaaagcgggatgaacgcttgaatctagaagtttgagaccggcctgggcaacatggtgaaaccccatctctacaaaaaaaaaaaaattacaaaaattagacaggcgtgtaggagtgaacatgtagtcccagctactccagaggctaaggtgagaagacctgcagagcctgggaggtccaggttgcagtgagtcgtgatcacaccactgcactccagtctgggcaacatagtgaaactgtgtttcaaaaaaataaaaaatgttctctggtgaggactcggtgattgagggtcagtgttcgatggagacttacttttttttttctttttgagacagtctctgttgcccaggctggaatgcaatagcaccatcatagctcactacagcctcgacctccaggctcaactgatccttcagcctcccgagtagctgggaccacaggcacgtgccgccacgcccagctatttttattttttgtagagatggggtctcaccatgttgctcaagctgatctcaaattcttgggctcaagcaatcctcctgcctcgaactcccaaaggcctggggttgcaggcataaaacaccacacccagccttacttttgtccatagacttattttaatttattaattaatttatttatttgagactgagtcttgctctattgcccaggctggagtgcagtggcacgatctgggctcactgcaacctccgcctcccaggttcaagcaattctagtgcctcagcctcccgagcagctgggattacaggtgcacaccatcatgcctggctaatttttgtatttttagtagagacagggtttcaccatgttggccaggctggtttcgaactcctgacctcaagtgatcctcctgtctcggcctcccaaagtgctgggattacaggtgtgagccaccgtgcccagcctaattttaacttttaactatgtacatgcattactgtgcacaaccagctgtgggcaagtacagcccaatagcccctcctcttcactgtcttgagtatctcttgctcgttgttgagggcccgtctagcgccatgccccataggctgcctataggagtccttttgacccttcaggcacccacacaattgtggaaatgtggctggaccaacaaatagtgggagtgagtggtaatccatgtgtgacatgcgagaggtgcacatttttttctctctctcttttttttttccatagaaatataaaatgtttgtagaaatgtaaaatcttttgtttttctttttttttatttttccagacaggggttaactctgtcacccaagttgggctgcagtggtgcagtcacagctcactgcagcctcaacatcccagtctaagggatcctcccacctcagcctcctgagtagctgggactacaggtgtgtgtcatcacacctggctacttcttttattttctgtagaagcagagtctcgctatgttgcccaggctagtcttaaactcctggtctcaaacaaattctcccacctcagcctcccaaagtgctgggattacaggcatgaggcactatgcccagcctgtaatcttattagcacacagccatgccccccactttttttttttttatttttgagagaggttctcactctcacccaggctggagtgcagtggcatgataaggggtcactgcagcttcaacctcccctggctcaggcaatcctcccatctcatcctcccaagtagctgggactacttgtgcatgccaccatgcccagctaattttttgtattttttgtagagatagggtttcgccatgttgctcagactggtcttgaactcctagattcaagcattctgcccacctcagcctcccaaagtgctgggattaattacaggcgtgagccaccgcatctggccgcctgcctgtttcttaatgcattgtctatgggcgcttttacacggcaacagaggaattgagaagctgcaacagaactcacttaaaatattttacccggcacttgaagaaaacatttgtccactcttgaattctttttcatactttttctaggccacaggtatattattaacagattaaccattattttttttttcagctatagccaataataataaaaaagagcaactcacattgatggtgcccttattgtgtgtgtgtcgtttcatggcatcctgaagacagctgagagacagatgtgatcatgcctgttttacagatggaaactgaggtttggagggttgaagttgcttctgagtaaatggctgagtcagtgcaacttgaccccagttctgctccactcacccaacgttgctcagccgttttcggttgtttcagtttcactgcagacacttctctgttctccccctgccctccttctctcccccaaactctctctcttccttctcctcctttctcttcttctgctccccaatccccctcctcctctttcatcttcttcctcctcctccttcctcctcccagccctcctcctcctcctcaacctcctccccttctatctcctccccctcctcctctttcttctccctcgccctcctctcttcttttctctcccccaaccccctctctactgggcctttgcatgtgcccatcccccagcctggaaacttcctcctgttctggttaatttctgctcattctccaggtctcagtctacctttttgttgtcgttgttgttgttgttgagacggagtctcgttctgttgcccaggctggagtgcagtggtgcgatctcggctcaccgcaagccccgcctcccaggttcacgccattctcctgcctcagcctcccgagtagctgggactacaggtgtgcgccactgcacctggctaatttttcgtatttttagtagagatgcggtttcaccatgttggccaggctggtctcaaactcctgggctcaagcgatccacttgcctcagcctcccaaagtgctgggattacaggcatgagccaccgtgcctggtctccaggtctgtttaaatgtcatttcttcctaaagctttcctggctaattcgattcttcttctcaaatgtatcttggggggtgaaaggtctgagaagagggaggggcatagagataaaggaagcttccaacagaggtgcatcaccaatgcccttctcccaggtccgaggtcatacccctggctcgaggggaggcggcttccgatgcctggtccatgctggggtatcaagttccagccctctcaccccagtttgggacaattctgtaggaccgcctcactggcagagcttgctgagggagtaagctgaggcctttgtaggccacaaggttgagaccagcctgagcatcatagtagggccttgtttctatgaaaacatttttttaaaaaatgaaacttcccacatgacaatttttttttttgagacggagtctcactctgtcacccaggctggagtgcaatggtgcgatctcagctcactgccacttccgcctcccaggttcaagtgattctcatctcagcctctcaagtagctgagattacaggtgcccaccaccacacctggctaatttttatatattttagtagagatggggtctcgccatgttggccaggctggtcttgaactcctgacttcaagtgatccgctcatctctgcctcccaaagtgctgggattacagccatgagccacagcgcccggcttccccatgacaattttaaacatgagaactatgtatatgccacagtctggaacttgggatctcaaataatcttggattccttgttctcagtccccatacagaagggaggagggctggcctttggactcccccaaatctgggttcgaatcccagctccaccactgcaagtctggttgctctggaccagttacttaacgttctctaaatgtcagttacatccgtgagataagctacctcgcgggacttcattcagtccttcttcaaatatctgtagaatatttgtaggctgaggcctttgctgggaccgtggagaagcccaacttcctcctccctttcccccacttcctaggctttgatccagccctggagccttgatcgaattgatctctctttcaagtcttccagggaggctgtgactcaatcctagaaaccaggggcaggtccaggctgcctgtggtctacttgctccacttcctcaggtgctcaagggtgactcatcactcagtaagttcagagcagagggcgttctcctcaatgtgtgccaggagcacagcaggaatgtaggcaccctcagagctccccagaattccctaaccctggaccacactgtggcattgcagcctatgtggggctgaggctctgtttcacattgggtgcccaatggactgctttacaggacagatgccttgttatcctgctctgctccggtagaacaaatatttgtagaaggaccgaatgaagtcctgcaaggtagctcatctcacagacgaaactgatgtttagagaacattaaataactggcccagagcaaccagacttaaagtggtggagctgggattcaaacccagatttgggggagtccaaaggccagccctcctcccttctgtatggggactgagaacacggaatccatgaccatttgagatcccaagttccagactgtggcatgtacatagttctcatgattaaaattgtcacgtgagaagtttcattaaaattttttttttttttttttttttttgtagagacaaggtctcactatgttgtccaggctggtctcaagctcctgacctcaagcgatcctcctgcctcagcctaccaaattgttgggattgtaggtgtgaaccactgcactctgcccagaggtttcaaagtgaactttttttctttaatcaagatggggtctcactatgttgcccagactggtctcaaactcctgagctcaagcgatcctcccgccttggcatcccaaattgctgggcttacaggcatgagccactgcacctggcctcaaagtggaatgtttttagtggggggaaggtgctggatattactgtcagtcctttagaggaagtaaaataaatcctacaggtacattgacattctcaggtcactttcagagggatgagcaataaattcattcaatgccttctttactaaaagcattagagataaagaaattctggaagtaaatcttgctgaaatgcattttgtcaggggaactcagttgaacaaaaactaaaggttgagttcagaaaaggtaaatgtcttttaccaagatttagttcttttcttccaggtagatatgccttttcttaggatctggagtgagaggctgttggaaaataagggttggggaaagccacagatggaattttacaaattggagacagctacttaatagaaacggcatctcatcagacaagtcaaggcaactgttgaaaatatgacatgtctctctatcagccattcatggcccaggacactatggcaaccaaatccaaactgctggttcaaagagattagtctgaatcccaaaagaatcctaattctctcctgatttattaaggaagaaaacaacaaccgcctttatttgcaatattattgcattgcatgcaatcctaggaaaaggtgtggctgttatttttgaagaagtactcaccctatactagatacagtatgaaacattattcatgcgtcattgcatttatttctcacgtgatctcaagaggtagatgctactgtcatcctgattttaagatgaagaaagcaagccttagggagttaaagggaactgcccaaggtcaaacagctggaaagagacttggccagacgcaaaaacagtctgatgcccggttcaaggtcctttagtttcatctgtccagtaagtagacagagtatttgatacttgggctggactagacaaatctatgatgtgtaattgttctgtgaactcacagatcctagcgtgaagagttttttgttttgttttgttttggtttttttagatgcagtttcgctcttcttgcctacgctggagtgcaatggcgtgatcttggctcactgcaacctccaccttccgggtacaagtgattctcctgcctcagcctcctgagtagctgggactacaggcacccaccaccacgcccggctaattttttgtatttttagtagagatggggtttcactatgttggccaggctggtctcaaactcctgacctcaagtgatccacccgcctcagcctctcaaattgctgggattacaggcgtgagccactgtgcccggcctttttttttttttttttttagatagggtcttgctctgtcgcccaggctagagtgcagtggtacaatcatagctcactgtagccttgaattcctgggctcaagcgattctcccacctcaacctccctgagtggctgggactacaggtgcgtaccattacaacacctggctaatttttttttattttttaatattttgtagagacaaattcttgttatgttacccaaggtggtattgaactcctggcctcaagtgatcctcccaccttgtcctcccaaagttctgagattacaggtgtgagccactgtgcttaaccaagtgaagacttttttggctagctcaaccctgtaattccagcactttgggaggccgaggtgggtggatcacctgaggtcaggagttcaacaccagcacggccaacatggcaaaaccctgtctctactaaaaatacaaaaattagctgggcatggtggtgggcgcctgtagtccgagctactcaggaggctgaggcaggagaattgctggaacctgggaggcggaggctgcagtgagccgagatcacaccactgcactccagtctggacgacagagcaagactctgtctcaaaaaaaaccccaaaaacaaaaaacaaaaatcaaaacaaacaaaaagcccaaaggaggactttttcatgctgataaagaatgtaggataaacctgataccctctccaaaatctcttccaattttcctaacctctgtaccaatgaggacttcctttcctttctgactttcgatcaatgtaacaaaaataaaattgaagcagagaagggttaagtatgttgctcaaggtcttgcaggtgatttgggttagagccaatcttgaactcagccaggtgaggtggcacctggttccatgactggaccctccctgctgccctggtttgcgagaagattcttacacacatgtccctgatctccttgaagctttgattttccacctagagccccactgcagcatcctggttatctgcgcaagctctgttgttacactgaactggatggtgaatcctgggtacctgtgtggccttgggcaaaaaaaaaaaaaaaaaaaaaagcacctctctgagcttccatttctttcattctttctttccctttcccctctcctcccctcccctcccctccccttctctctctctctctctctctctctctctctctttctttgttggagtctccgtctgttgtgcaggctggagtgcagtggcgcaatcttggcttgctacaacctctgcctcctggcttcaagcaattctcctgccttggcccccctgacgagctgggattacaggcatgcaccaccatgccagctaatgtttgtatttttgtagagatggggttttgccatgttggccaggctggtctcaaacttctgacctcaagtattacgcccattttggcctcccaaagtgctgggattacaggtgtgagccaccacacacgttcttgggcctccatttctacagctattaaaaggaggccataatagtacctaactcctgggatattatcgtggctaaaatgagctaatgggccaggtgcggtggctcacatctgtaatcccagtactttcggaggccgaggcgggtggattacctgaggtcaggagttcgagatcagcctggccaacatggcgaaagcccgtctctactaaaaatacaaaaattagccaggtgtggtggcttgcacctgtagtcccagctactcgggagtctggggcaagagaatcgcttgaacccaggaggtggaggttgcagtgagctgagattgtgccactgcactccagcctgagtgacagagctagactccatctcaaaaactaataataataataataataataataataataataataataatatcataataagatgggcctggcgcggtggctcacgcctgtaatcccagcactttactctactaaatctctactaaaaatacaaaaattagccaggtgtggtggcgggtgcctgtaatcccagctacttgggaggctgaggcaggagaatcacttgaacctgggaggcggaggttgaagtgagccaagatggcgccattgcactccagcctgggaaacaggagtgaaactctgtctcaaaaaaattaaataaataaataagtaaataaataaataaaatgaactaatgcatgaagagcacttagttaaattaaataaataaataaaatttttaaaaaataaaattaattaaataataaataaataaataaaatgaactaatgcatgcaacaacttagcacagtgcctaggacataataggcactcgataagtgggctgggcgtagtggctcatgcctgtaatctgagcactctgggaggctgaggcgggcagatcacctgagctcaggagttcaagaccaccctgggcaacatggcgaaaccccatctgtacaaaaattacaaaaattagctgaccatggtgatacccacctgcagttccagctacttgggaggctgaggtgggaggatcacttgagcccgggagactaaggttgctgtgagcccagatcatgccactacactccagcctggtggacaaagctagaccctgtcacacacacacacacacacaaaagtggctatttcctcaccattccccccttggcaggtcacagcccagtccactccactcctccatggtctccattcttgtcgcctcgacaccagatggcctggattaggtgtgtaagaacatatttatgctccagttttctcttgtcaaattcctcatccttcctctccccttcccagatgttctccattctccgcaaatcctctacctcacctccatcttccacctgctctttggtcactctgtctcctactcaactaggaagaccctaggaaccctccacttggaccctaaatctctttgcattttaacctttcattcatgaattcattcattcgaaagatattattgagcatctactatgtaccaggcactaaggatactagagtaaatataataaacaggatcctggctgggtgaggtggctcatgcctgtaatctcagcactttcggaggtaaaggtgggtggatcgcttgaggtcaggagttcgagaccagcctggccaacatgacaaaacccgtctctagtaacaatacaaaaattatctgggcatggtggtggcacatgcctgtaatcctagcaacttgggaggctgaggcaggagaatcgcttgaacccaggaagtggaggttgcagtgagctgagatcacaccactgcactctagcctgtgcaacagagcaagactttgtctcaaaaaagtaaacacggtctctactcacatagagctcactggccaagagaaagggcagcaattcatcaaatatttaattacaaactcagataaatactataatgaaaaatgcagagattctgagacagtcaggggccataacctagcctaggttggtggttatggaaggcttccatatcagcatgtgtttctttctttctttttcttttttcttttcttttctttttttctttttcttttttttttttgagatggcgtcttgctctgttgcccaggttggagtgcagtggcaccgtctcatctcactgcaacttccacctcccaggttcaagcaattctcatgcctcagcctcccaagtagctggggttacaggcttgtgccaacacacctggctaatttttgtatttttagtggagtgcagtggaaccatctcggctcactgcaacttctgcctcccaggttcaagcgattctcatgcctcggcctcccaagcagctgggattacaggcgtgtgccaccacacctggctaatttttgtgtttttagtagagatgaggtttcacaaagttagccaggttggacagcacgagtttctatgcaacacactgtcctaaaacttagtggcttaaaacaacaacaatcattgatttcacccccaaatctgcaatttgggcaggatgtggcctggacagcaagtctgtgttccacatgccatgctcaacatggggcagcttgacaggggctggaggacccacttttttttggttgtctctgagatataatttacatgccataaatttcaccatgtgaaaccatacaattcaatgctttttagtatattcacaggattgtacaactattgctatctaattccacgatatttccttttccctaaaaagaaatcctatacttatctggatgtggtggcgcacacctgtggtcccagctactcgggaggctgagacagggggatcaattgagcccaagagttccaggctgcagtgagctatgatcgcaccattgcactccagcctgggtgacagaatgagaccctgtttctaaacaacaatgacaagaacaacaacaacagaatatataccattagcagtctcttctattccctcttcccctagtccctggaaacactcatctatcttctgtctttatagatctgtctgttctagacacttcaaatggaatatacactacgtggcctattgtgtctggcttctgtcactgagtacaatgttatcaagattctggaagacccactttgtggatggctcagtcacatggctggcaatttggtatttgctgtcaggtgggaactcagccagggctgtgggcagggatcccatttcttctctatgggggccccctccacgggctgcttgagcttccttatggcatggtggttgggttccaagatggagcatcctaacagagccaagtgggagcttttcatatcttttttttttttttcaattgagacaaagtctcactgtcacccaggctggtgtgcagtggcatgatcttggctcactgccacctccacttcctgggttcaagtgattcttgtgcctcagcctcctaagtagctgggactacaagtgagcgccaccacgcccagctaattattgtatttttagtagaggctaggtttgccatgttggccaggctggcatatttattaaaaaaaaaaaagagagagagagagagacagggtcttgcttgttgcccttggcaggtcacagcccagtccactccactcctccatggtcttgaactcctagtctcaaatgatcctcctgcctcatccttccaaagtgctgagattacagatgtgagccacgatgtccggccagcttttcaccttttatgaccagtttcagaagtcacaccatgtcacttccacagtagcctcaagctcgtctggattcaagggaagggaacacagaccacccttcacaacaggagtgtcaaagtcaccttgtttgcgttttaacttttcattaatgcattcattcattcaaaagatattattggccaggtgcagtggctcaaacctataatcacagcaccttgggaggctgaggcggatggatcacctgaggtctggagttagagaccagcctggccaacatggtgaaaccccgtctctactaaaaatacaaaaattagctgggtgtagtggcatgcgcctgtaatcccagctacttgggaggctgaggcaggaaaatcgcttgaacccgggaagtggaggttgcagtgagccgagattgcgtcattgcattccagcctgggtgacaagagtgaaaatccatctcaaaaaaaaaaaaaaaaaaaaaaaagtcacaccatgtcagttccacagtagcctcaagctcatctggattcaacggaagggaacacaggccacccttctcaataagagtgtaagatcactttgtttacattttaaccttttattcatgcatgcgttcattcaaaagatattattgagcatctactcatgaatgaataattgtggccacttttggaaaatacaagtgctacagcttccctgagaagatgatgttggggctgacagctgaaggataagcaggtgttacttaggcacaggtatggaagagcattcaaaaaacacagaacaacgtgttcaaaagacccgggggaacaattagcacactggaggaacttaaggcggccttgagtggcagaggcagagagaaaggcacttgtctgttgtgtgctttccatgactgctgtttccactcagccttcattgtccattttttcagaaacagtaccctaaattccctttggggaaccattgactcacccgccctcagccctctcagtggggctggctgcaggggtgggtgttaagacccaggtctagccattcaagacagttcacccagcctcgccagtctcactgattggttcgggtgtggtcatgtgacactcagaagggccaatgaggctcaaacccaagacatctgctgcagctattggacaagacagagtgtattgccttggggttgctaggtaggatagaggcaggagtggttgggtgtcacctttgcctctgccagagaataacctgttgaaatgacaccaacaaagagaaagtagaacgaagtgacacagaccattgagctcctggactatgaccaaagccagctctgccactggacattttagattcatgggccaatacatgatggtttaggctaatttgaatttctgtcacctggaatcaagagtactgtttaaaggcaccatcggtgggcgcagtggctcatgcctgtaatcccagcactttgggaggccgaggcgggtggatcacccgaggtcaggagtttgagaccaccttggccaaaatggcgaaactccatctctactaaaaatacagaaaatagccgggcatggtggcacgtgcctgtaatcccagcaactagagggtctgaggcaggaggatggcttgaacctgggaggcagaggttgcagtgagccatgattgtgccactgcactccagcctgggcaacagagtgagactccatctcaaaaaacaaacaaacaaacaaataaataaataaagacactatggttaggatttttctcttcctgtccctaactacacattctccattcctggttcttacgtaccacttcagaagcctccagcacttcatctggcctctcttccttctctctctctttcatttcttattttttttgagacagagtctcgatctgtcacccaggctggagcgcagtggcgcaatcttggctcactgcaacctccacctccaaggctcaagtgatcctccagcctcagcctcctgagtagctgggattacaggcacacaccaccactccaagctaactttttgtatttttagtagagactggtttttgccatgttgcccaggctggtcccaaacttctggccccaaacttctggcagatcaagtgatccacctacctcggcctcccaaagtgctgggattacaggtgtgagccactgcatctagccttctctcttttttttgtgatcaataaatgtttgtttattgcatcttggtctgaatgtcatattaaatttggggttccaaaaaactctagaaaacatttatgagaacttgggaggtggaggttgcagtgagccgagatcgcgccactgcactccagcctgggtgacagattgacacttcgtctcgccaaaaaaaacaaacaaacaaaaaaaaaaaacaaaaaaagaaaaaaagaactaaatgtccctgaatataaaatggtaggtaagaacagtaattggcttgtcgatcaatgatgaatcaaacagaaaatgcgtgacagattatggggaagtttaaaatgtccaaatattatgtcccagaagaatttgtctagataatagatcttcctcagtccctttcaggggatggatggatagtggacatacttgggcaggtttattcagggtaagctggaggaatgtgtcaaataggtagctacctatctgatttactttcatcctattttttctgctcttaaaacaaaataacctcctattggttaaacttttttttttttttggttgcaaatcaaactctcttactggttttaaaatatcaatttcttttctttttctgtttctttttttttttgaggcggagtctcactctgtgacccaggctggagtgcaatggcatggtcttggctcactgccacctccgcctcccgggttcaagcgattctcctgcttcaggctcctgagtagctgggactagaggcatgtgccaccacacctagctaatttttgtatttttagtagagacagggtttcatcatgttggccaggctggtctcgaacttctgatcttgtgatctgcccgccttggcctcccaaagtgctgggattacaggcgtgagccaccgtgcctatcctattttttttctttttctttttctttttttaagatgaagtcactctctgttgcacaggctggagtgcagtagcacgatcttggctcactgcatcttttgcctcctgggttcaagcgattctcagcctcctgagtagctaggactataggcgcgcgccaccacgcctggctaatttttgtatttttttacagagggggtttcactatgttggccaggctggtctcgaactcctgacctgaagtgatccacccaccttggcctcccaaagcgctgggactacaggcatgagtcaccacgcctggccaaaaaaaagattaatcttaaacataaccagaagtctagatgtttgacaggtttatttatttattgagacaaggtctagctctgttgcccaggctggagtgcagtggcgtgatctcttgggtcactgcaacctccacctgtgggttcaagacaccctcccatctcagcctcctgagtagctgggactacctgcctggctaagttttgtatttttagtagagaccaggtttcaccatgttgcccaggctggtcttgaactcctggcctcaagtgatccagcacctggcctcctaaagttctgggattacaggcgttggccaccatgcctggtcagtttggcaggtttaagggttgacttatgcctgtgactgtggctatctttctttatattctcatggcttaccccaggctggccacttgtaatatatggtcatcttaaccaaattagaaaaaggtattccagttgatgtggtggctcacgcctgtagtcccagcactttgggagaccaaggtgggtaggtctcttgagcccaggagtttgagatcagcctgggcaacataacaagacctcgtctctacaaaaaatacaaaaattagctgggcatgattgtgcatgcctgtagtcacagctactcgagaggctgaggtggagcccagaaggcagaggttgtagtgagccaagatgggaccactgcaccccagcctgggcaacagagccaacctgtcttaaaaaacaaaaaacaaaaaacctgacatgggactttgaatattctagtattgaatgaatgaggaataaagagatggatgggtggatggatggacggacagatgaatgaattgatagatggatgagttgaatgggtgatggaaggatggatggatggacaggtggatgaatggatggatgggtggtggatgaatggatggacaactgaatgaatgaatgaatgaatagattgacaagtggatgggtgatgggtggaaggatagatggtcagatggatgggccatggacggatgaacggacagatggatgagagagagagagagattcctctgggcagcagacaatttccttaaaaacaaacaaacaaaatctcctttttcgggaagatacaaccacacatacgggctgaatgtcagcccccaatcatctactcggcacttccatagcacagggcacaattttgggcaagtgctcatttcgtgaggaccacagacaggcaccatttttttaagggttggtgggatgatcaccactgtttgaggccttatattcaaggattacaatgttcagaggagaaaatagaacgacttccaggatctctgccagagcgccaggaagaacttcctcggaaacatttaacaaaactctcctcgtatctcattggcctgatttgagttacatttcctttcttttctttcttttttctttttctttctttctttctttctttctttctttctttctttctttctttctttctttctttctttccttccttccttccttccttccttccttctttctttctttctctctctctctctctttttttctttccttccttctttttttttttcttttttttgagacatggtccagctttgtcgttcaggctggagtgcagtggcacgatcttggctcactgcaacctccgcctctgggttcaagcaattctccccgcctcagcctcctaagtagctgggattacaggcacccatcaccacgcctggctgatttttgtattttttagtagagatggggttttaccattttggccaggctggtcttgaacccccgaccttaggcgatccgcctacctcggcctccgaaagtgttgggattacaggtgtgagccaccgcgcccggccttctttctttttttgaggtaagattcacaaaacatttttaaaatcaccctttggggccaggcatggtggtgtgtgcctgtagttccagccactagggaggctgaggcaggaggatcacttgggcccaggagcctgaagtgcgctatgatcactccactgtacttcagcgtgggtgacagagtgataccctgtctcaaaaaaaaaaaaaaaatcaccatttaaagtgaatagttcactgttttttgtcacattcacaatgttccacagctatcatcactatctagaacatttttaccacagcaaaacaaaagaaaaaaacaaaaagcaaaacaaaaaacaaaaaaccataaccattaagcaaacattctccattccgcccctcctcctaggccctgagaaccacaatctacttcctgtctctccggctttgcttattccgtgtgtttcatcccatataaatatattcataaaatatgtggtcttttgtgtctgtgtctgtttccttcctctccctttctttctttctttctttctttctttctttctttctttctttctttcttcctttttctttctttctttccactttctttctttcttcctttctttttctttttctttcctcttttctttcatatcatggctcactacagccttgacctcccaggttgaagagatcctgccacctcagcctcccaagtagctgggactacaggtgtgcaccagcacccctggctaatttttgtatttttttgtagaaacgtgctgttgccatggtgcctgggctggtctggaactcctgagctcaagcaatctgcccaactcggcctcccaaagtgctaggattaccggtatgagccactgcgcctgactggggttcttttttgtagcatgatgttttcaaggttcatgccagttgtagcatgcatcagtattttcttccttttcatgtctgaatgatattccactgcatagataaactaaatattatttatccagtcgttaattgatgggcatttgatttgtttccactttatggaccgttacgaatagtgctgctatgagcatttgtgtgccagttaatgtttgaacacctgtatactagtatacacccaggcattaaattgctgggtcatattgtaattctatgttcaactttttgaggaactgccaaactgttttccatagaggctgtaccattttacattcctagcagcaatgtacaaggcttccagtttctccatatccccatcaggcttgtaattttccttttttttttttttttttttttttgacacagagtctcactctgtcgcccaggctggagtgcaggggcgtgatctcggctcattgcaacctctgccccctgggttcaagcgattctcctgcctcagcctcctgagtagctgggattacaggggcctgccactgtgcctggatgatttttttgtatttgtagtagagatggggtttcaccatcttggccaggcttgtcttgaactcctgacctcgtgagccatggcgcctggctgtaattttccatttttaaaaattataaccattctattgtgtgtgaagtggcatctctttgtggtttttatttgcatttccctaataacgaatgatgttgagcatctgttcacgtgcttgttggccatttgtagatcttctttggagaaatgtcttcaaatccggggcccatttttaaaaactgggtgctttgctttttttgttgttgagttgtaaagttctttacatattccagacagtagagccttatcaaatatgtgatttgcaaatattttctctcattctgtgaactgccttttctgtccttcgatactgttctttgatgcataaaaggttttaattttgatgaagtctagtttctcaacctttgctgttgtcacttgtgtttttggtgtcatatttaagaaaccattgccaagccaaagataatgaagatttccctctgggctctcttttaagtattttatagttttaacttttataatttagatgttaatattatggcgtgagttcaaagtccaatttcattcttttgcatgtggatatctcatggtcccagggtcatttgttgaagagactgttctattaaattatgtcttttaggctgggcacggtggctcatgcctgtaatcctagcactttgggaggccaaggtgggtggatcaccagaagtcaggagttcaagaccagcctggccaacatggcgagaccctgtctctactaaaagtgtaaaaattagccaggcatggtggtgtgcacctgtagttccagctacttgggaggccgagacaggagaattgcttgaacccgggaggtggaggttgcgtgtgccgagattatgccactgcactccagcctggatgacagaacaagactccatctcaaaaaaaagaaaaaaaatatatgcctttttcagcaatttggatggagctggaggccattaatctaagtgaagtaactcaggaatggaaaaccaaatattgtatgtcctcacttataagtaggagctaagctatgagtacccaaaggcatacagagtgatataaaggactttggagtctcagaagggggaggatgagaggagggtatggatgaagactacatgttgggtacatgtgtaactacttgggtgatgatgggtgcattaaaatctcaaaatttaccactatataattcatctatgtaaccaaaacccacttgtaccccaaaatctattgaaatttttaaaaaaagagagagagggaaactgttctttcgcctattgaatggccgtggcacgcttgtcaaaagccgattcactggctgggcatggtggctcacacctgtaatcccagcactttgagaggccaaggtgggtggatcacctgaggtcaggagttcaagatcagactggccaacagggtgaaagcccgtctgtactaaaaatacaaaacttagccaggcgtggtggtgggtgcctgtagtcccagctactcgagaggctgaagcaggagaattgcttgaatccaggaagtggaggttacagtgagtcaagaattcgacactgcactccagcctgggtgacagagcaagactccatctcgaaaacaaacaaacgaacaaacaacaacaaaaagccaactgaccacactgggtgcagtgggtcacgactgtaatcccagcactttgggaggtcaaggtgagaggattgcttgagcccaggagtttgagaccagcctcagcaatatggcgagacttcatttgtactaaaaacaaaaaacattagccaggtgtggtggcacgtgcctatactcccagctactagctatgtgggaggctgaggtgggaggattgcttgagcccaggaggtagtggttacaatgaactgtgattgcgccactgcactccagccagggcaacagagaaaatgctgtctcaaaagaaaaaatcaattgactatagatgtatgggtcatttccagactttcaattctattccactaatctatatgcctatcctcataccagtatcacaccttttgattattgtggctttgtagtaaattctgaaatcaccaagtgtgagtcttccaactctgctcatttttcaagattggctcttgggtgcaataccatgtgaatattaggtttgaattttccaggtctgcaaacaaggacgttgggattttcatagggattatatcaagtccatagatcactttgggatagtattatcatcttaacaatattaagtcttctaattcataaacacgtgtattagtctgttttcatgctgctgataaagacatacccaaggctggggagtttacaaaagaaatcggtttaatggtcttacagttccatgtggctagggaggcctcacaatcatggtggaaggcgaaaggcattttctacatggcggtggcaagcgagagaatgagagccaagtgaaacgggtttctccttataaaaccatcagatcttgtcagacttattcactaccacaagaacagtacgggaaaaactgcccccatgattcaattatctccccctgggtcccttccacaacacgtgggaatcatgggagtacaattcaagatgagatttgggtggggacaaagagccaaaccatatcaacatgtgacgtcgtctttctatttatttaggtcttcgtatttgctttcagccacgttttgtagttttcagggcactagtgttactcctacttggttaaatttatttatttttattctattggaagtgaaattgttttcttaattttactttctgattgtttattgctagtttatggaaatgtggctgatgtttgtgcgttgatcttcttttttttttttttttttttgagatggagtcttgctctgtcacccaggctggagtgcagtggcatgctcttggctcacagcaacctctacctcctgggttcaagtgattctcctgcctcagcctcccaagtacctggaactacaggtgccctcaccacgcccagctaatttttgtattttttactagagacaggctttcaccatgttggccaggctggtctagaactcatgacctcaagtgatccacccacctcggcctcccaaggtgctgggattacaggcatgagcaaccacgcccagctgcaaactaccttttcaatgacagttgtctcctaatttgttggcctcagcataggtagataataataaaacctacattttaaaacattaaagggcaatgttcagccaggcacagtggctcacgcctgtaatttcagcactttgggaagctgaggtggacagatcacctgaggtgaggagttcgagaccagcctggccaaaatggtgaaaccctgtgtctactaaaaatacaaaaattacctgggcatggtggccgacacctgtagtcccagctacttgggaggctgaggcaggagaattgcttgaacccaggaggcagaggccacagtgagccgagatcgtgccactgcattctagcttgggtgacagagagagaagcggtctccaaaaataaataaataaaaatagatgagtcacttccaagatggccaaataggagcagctccggtctgtagctcccagcgagatcaacacagaagacaggtgatttctgcatttccaactgaggtacctggttcatctcactgggactggttggacagtgggtgcagcccacagaggtgagctgaagcagggcagggtgtcgcctttcccaggaagtgcaagggttcaggggatttccctttcctaggcaagggaagccgtgacagactgcacctggaggaacggtacacttccatccaaatactgtgcttttcccacggtcttagcaactggcagaccaggagattctctcccgttcctggctcggcaggtcgcacgcccacagagccttggtcactgctagcgaagcagtccaagatcaacctgtgatgctgcagcctggtcagcaactatcatcagactgaacaggcaatctacagattgggagaaaacttttgcaatctgcccatttgacaaagggctagtattcagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcacgccagttcgaacggtgatcattaaaaagtgaggaaacgacagatgctggagagggtgtggagaaataggaatgcttttacactgttggtgggagtgtaaattagttcaaccattctgcttaatagccacacactgtgtggctattcctcaaggatctagaaccagaaataccatttgacccagcaatcccttcactgggtatatacccaaaggattataaatcatgctactataaagacacatacacacatatgtttattgtgccactattcacaatagcaaagacttggagccacccaaatgtccattaatgatagactggattaagagaatgtggcacatctacaccacggaatactatgcagccataaaaaaggatgagttcatgtcctttgcaaggacatggatgcagctggaaaccgtcattcttagcaaactatcacaaggtcagaaaaccaaccaccacatgtttcactcataggtgggaattgaacaatgaaaacacatggacacagggcagggaacttcacatattggggcctgttgggggtagtgggggcggggagggagagcattaggacaaatacctaatgtaaatgtcgagttgatgggtgcagcaaaccaacatagcacatgtatacctatgttacaaacctgcacgtcgtgcaacgtcgtgcaaatgtattgtagaagttaaagtataataaaaaaagaaaaaaaatccattcatatatcaataaaaaatagatcaatcaatcaataaaacattaaagtgcaatgtcgacaagaggtggtaaaagcaggcatccttgtgttgttcctggtctttgtggggaaatctttaaatttgtaagcctttcactgttgcatatggtgtaagtctcttcctttctttctttctccttccttccttctttccttccttccttccttccttctttctctcttccttctttttctttctttctataaatagaaacagcaggccgggcacgctggctcagcctgtaatcccagcactttgggaggccgaggcaggcggatcacgaggtcaggagatagagaccatcctggttaacacagtgaaactccatctctactaaaatacaaaaaaaaaattagccgggcgtggtggtgggcgcctgtagtcccagatactcgggaggctgaggcaggagaatggcctgaacccaggaggtggagcttgcagtgagacgagatcatgccaccgcactccagcctgagcgacagagcgagactccgtctcaaaaaataaataaataaaaataaataaataaatagagccagcgtctcactatgttgcccaggctggtctcaaacttctaggctcaagcaatcttcccaaagtactggggttacaggagtgagtcaccttgcctggcctggtgtaagttttttatatatgccctttatcctgttgaagaagttctcttctggtctttattatttcagtattctttgttgttgttgttgttgttttgttttgttttgttttaaatcctgaaaaggtgttgggttttgtcaaaggctgttttctacattatcccttaattctattaatgttgtgaataacatttatttatttatttatttatttatttacttattttgagatggagactcactcagtctcccaggctggagtgcagtggcatgatctcggctcactgcaacctccatctcctgggttcaagcaattttcctacctcagcctccctaacacctggcattacaggcgtgtgtcaccacgcccagctaatttatttttattttttgtatttttagtagagacggggtttcaccgtgttggccaggctgatcttgaactctttacctcaaatggtccacctgcctcggtctgccaaaagtgctgggaatacaggcgtgcactaccgtgcctggctgagttttttcttttttgagacagggtctcactttgtcacccagggtggggtgcagtggcacaaacatggttcaccgcagcctcaacctccccagctcaagtgattctctcacctcagcatgccaagtagctgggactacagttgtgagccactgcgccctgccctgattttcttataatgaatcacccttacattcttgggataagtctcatctgttaacacatatgtataatatgtttctatgctgctggatttgatttgctagtattttctttaggatttctgcatctatatttataagggacattggtctatagtttccttttcctgtaatgtcattgtgtggctttggtatcagggtaatgctggcctcatagagtgggtcagaaatgttgcctcctcttctagttttgggaagattttaataagaattggccttaattattcaaatacctggtagaattcaccaatggagccatcgggtcctgagcttttccttacggaactttaaaaaattgttaccaattccatctctttccttgttatagatctattccgacttcctagtttttcttgggttagtcttggtaatttgtgtgtttctagaaatttgtacatttcttccaggtgtattcaattaattgacatgtcattgtttatagtattctcttataatcttttatttttgtaagggttgtagtaatctttggttcctgattttagtggtttgggccatctccattcttcttctgggggcatcagtatttccaaaagtttagcaattttgctgatttgttaaagaaccagtttttggttttgttgactctattgcttttatagaatactatattttatttatcttcactgtaatttttattgtttttttgctgctgcttgctttcggcatagtttgatctttttctaatcccataaggtggaagaatgtattatttatttgagatctgtctttctttttttgcttgagacaaggtcttgctctgttgtccaagctggagtgtagtggtgcaatcatggctcactgcagcctcaaactcctgggctcaagtgatcctcctgcctcagcctcccaagtagctgagatcacaggcatgtgccacgatgcctggctagattttttatttgtatttttcatacagatagggtctcgctatattactgaggctggtctcaaactcctggcctcaagtgttcatttttttttttttttttttgagatggagtttcactcttgttgcctaggctggagtgcaatggcacgatctcagctcaccacaaccttcgcctcatgggttcgagtgatccacctgcctcagcctcctaggtagcaaggactacaggcatgtgccaccatgcccagctaattttgtctttttagtggagatggggtttctccatgttggtcaggctggtcttgaactcctgacctcaggtgatccacccgcctcagcctcccaaagtgctgggattacaggcgtgagccactgcgcccaccctctttcatttttgatgtaggtgactacagctataaatttccctctgagcattgtctttgctgcatctcataagttttggtaagttgtactgctttttcattcatctcaaaatatttaaaaatttttttatgatgtcttattttactcattgtttatgttaatttctacataatcgtatatttgtgaatctaaaaattttctttctcttgttgatttctagttttattctgttgtggttgaagaaattactttttttttttttttttggcagggtctcactctgtcgcccaggctggagtgcaatggcctgatctcagctcactgcaacctccgcctcccgggttcaagcaattctcctgcctcagtctcccaagtagctgggattataggcacccgccaccacacccagctactttttgtatttttaatagatatgcggtttcaccatgttggccaggctggtctcaaactcctgacctcaggtgatccgcctgcctcggcctcccaaagtgctgggattacaggtgtgagccaccgcacccggccaaaagtactttgtatgatttcaacttttttttttttttttttttttttgagacagggtctctctctgtcgctcagtctggagtacagtggcgtgatctcagctcactgcaacctccacctcctgggttcaagcaatcctcctgcctcagcctcctgagtagctggaattacaggtgcccacaaccatgcccagcaaattattgtacttttagtagagatggggtttcactgtgttggccagggtggtctcgaactcccgacctcaagggacccacctgccttggcctcccaaagtgttgggattacaggcgtgagccaccgcgcccagccgataactcaaaaattttcaagaggcaaagacttattttttaacagatgtgagactcagtgttttaaacaagacccaataaagacagtatgaggctaactgaatctgtccctcctgcaaagaaacatttttttactgttttttaatattacatgaaaattttgtttaaaaaactaaattttacctttgtatgtaaaattgttcctttagtagttttaattacatatattataatgttaactcttaggcagtctccgcctctcgggttcaagcaattctcttgcctcagcctcccgagtacctcagactacaggtgtgcaccaccatgcatgcccagctaatttctgtatttttagtagagacagggtttcgccatgttggccaggctggtctcaaactgctgacatcaggtgatctgtccgccttggcctcccaaagtgctgggattacaggcgtgagccactgcatccagccattactgacttttatttttaatgaaaaactaaggaggtaggcaattttaattatgtaccaggtacagagtctaggacagtaataatatatgtcaataatatatgatgctttttaggataggcaggggacatggttaattctacacatccccaggccttatctacaatctaagggctttaaaatagacaagtccaacaattatttaaaatattatagaagggccaggcatggtgcctcatgcttataattctagcactttgggagcagaggctggtggacgccttgaacctaggagttagagaccagcctggccaacatggtaaaactcgatctccactaaaaatacacaagtgagctagacatggtggtacgtgcttatagtcccaactacttggaaggctgaggtggaaggatcacctgagcccagggaggttgaggctgcagtgagcatgccactgtactccagcctgggcaacagagtgagtcccagtctaagaaaaaaatttataaaagtagtttaggacctgaaaggtcttagtaaagacaataccagacttgtctaatttacaccaaatgttcacattctgaagatgtttttattttactaataattgaaaaactgtctttatttactaaagattattaaagtcatgtgaactaaaagatacttaaagtttttattttttgatgaaatattcaatttaagtggttaagtcaactgattagagcttttaaaaatatatttcagtagtgaaatattatatattcatggcacatataaacatagacataacagacagaagtagatcttatagacttgtaagactttctgtcaattttaaaatttttattaattaattaatttattagagacaaggtctcactctgtcacccagactggaatgcaatggtataatcatagctcactgtagcctcaaattcctgggcttaactgatcctctcgcttcagcctcctgagttgctgggactacaggcatgcaccaccatgcccagataattttaaaaattttttatagagatggtgtctcactttgttgcccaggcaggacttgaactcctggcctcaagtgatcctcatacctcagcctcccaaagtgttggaattacaggcttaagccaccacatctggctggttttaattattaaacaataacaaaaaaattcattttctaaaaaaaagagtactgtggcctctatacaaaaataaagaaaaacaatttagcatagtgaaaacaagatagagtcaataatattaaatttgtatttttgagacagagtctcactctgttgcccaggcttgagtgcagtggcttgatctcagctcactgcagcctctgcccccctggttcaagcaattctagtgcctcagcctccggagtagctgggactacaggcttgcaccaacatgcttggcttatttttctatttttagtagagacagggtttcaccatgttggccaggttggtcttgaacccctgacctcaagtgatctgcccgcctcagcctcccaaagtgttgagattacaggcgtgagccaccgcgcccagtcaattatgttaaattacccttattactatgatttttataaaagtggtttcaagcatataaagaatgtttgttattactattatgtattattttctttatcatgatacttcagtcaaaaggaactgcttaggacagcttgaatatgtcccatagttacagcctgcaagcctttttctttgctgtgccatgtgcctaagacaccatccttcgtttgtgtgtgtcaaaaccccaccagtctgtcctcttaatcccaacaccaatgtcctgggtgccaataaaggctttcctcacctccaaattgagattttattgacctctcttggggtgcttatactggctttgggttgaaatctattttttctcctctcccttgaagaagcacgtctctttgcttaagggaacgtagaagccacagcagatcctagcagatatctgttaccctgaagaagaggtcagggcccaggcacggtggctcatgcctgtaatcccagcatttggggaggtcgaggtgggcggatcgcttgagcccaggagttcgagcccagcttgggcaatatggcaagacaccgccccccgactctacaaaaaatacaaaaattagccaggcgtggtggtgagtgcctgtagtaccagctacttgaaaggctgagttgggagaatcagctgagcccaggaagttgaagctgcagtgagccgtgatcgcaccactgcactccagcctgtgcaacgtggcaaaaccagagtggggccttgtctcattttaaaaagtaataagagaccgagcacgggaactcaggcctgtaatcccagcactttgggaggctgaggcggccagatcacttgaggccagagagttggagaccagcctggccaacatgggaaaaccctgtctctactaaagatacagaaattagccgggtgtggtggcaggcacctgtaattgcagctactgggaggctgaggcaggagaatcgcttgaatctgggaggcggaggttgcaatgagcagagatcgagtcactgcactccagcctgggccgcagagcaagaccctgtctcaaaaataaataaataaataaataatttaataaataagaagaaagggtcagggccatttttaaaaggcactagataaggcctggttgcaatcagggagtgcgggcaactgatttctttgaagcctcctcttgttctgtttccgtgacattgacagggaccagctcccatggttcaggagctgctgagggttaacatcctgtcccaggagggatctgaccacaccaatggctttatcgttgcctaattggggaggccctgtgggggatgtttcaaggactgagagtgcagaggagcctcccgcatgcagttacgctgatggaaacacaatgggtggattgccacaggggcccgcaggctcgctggcaaacagagcgcacaggtggaaaccttccccgctgaccagatactttgtttcctttctggggaggcagataaaacagttaccataacccaaaccctgcccactcttcatttgcaaactgcaatgctcttagacatcttccttaggtaagcgctttgagagctcctgttcatttcaggactaaaatgaacaataatagcgaccgtccttcagagcctgctggatgccaggcacctcacaagtgtctcccagtgctgggtgcagtgattcacacctgtaatcccagcactttgggaggctgaggtgggtggatcgcttgagctcaggagatcaagaccagcctgggcaatatagtgagaactctgcctctaaaacaaagaaaaaggaaaaagtaactcctggtgaatttccaccttagaacaagagtgggaggtgtcctattcatgatctttaatgctttgctcaaatatcaccttctctgtgaggcctaccctgaccactctgcttaaaattgcaaccctccaccacctccaccccgcatcgcaagttctcgtcacagcctttctcacctgctacccactccatgatttacttattaagtatgtttgttaggccgtgtgcagtggctcatgcctataatcccagcactttgggaggctgaagcaggtggattacctgaggtcaggagttcaataccagcctggccaacgtggcgaaaccccatctttacaaaaatacaaaaaagttagccaggtgtggtggtgcgtgcctgtagcccagctactcgggaggctgaggcaggggatttgcttgaacctgggagggaaggttgtagtgagctgagattgcaccatcgtactccagcctgggcggtagagcaagactctgtttcaaaaaaaaaaaagtattgctaagtcaaaaagtataaacagtctaattttttttttttgagacaaagtctcgctctgttgcccaggctagaatgcaatggcacggtttcggctcattgcaacctctgcctcctgggttcaagcgattctcctgcctcagcctcccgagtagctgggattacaggcatataccaccatgcccagctaactttttgtatttttagtatagatagggtttcaccatattggccaggctggtctcgaacttctgacctcgtgatccgcccgccttggcctcccaaattgctgggactacaggcaagaaccaccgtgccctgcctgaagagtcgaaatttttttttttttaaacagtttcactctgtcgcccaggctggaatgcaatggcacattctcagcccactacaacctccgcctcccaggttgtagccattctcctgcctcaagcctcccaagtagctgggattataggcacccaccactatgcctggctacattttgtagtttttttttttttctttttgagacggagttttgctcttgcttcccaggctgtagtgcaatggcgccatctctgctcaccacaacctccgcttcccagattcaggtaatcctcctgcctcagcctcccgaatagctgggattacaggtatgcgccaccacgcccagctaattttgtgtttttagtagagatggggtttctccatgttggtcaggctgaacaaccgacctcaggtgatctgcccgcctcagcctcccaaagtgctggaattacaggtgtgagccaccacgcctgggtctactttttgtagtttttagtagagacagagtttcaccatgttggtcaggctggtctcgaactcctgaccttagtcgatctgcccgcctcagcctcccaaagtactgggatcacaggcgtgagccactgcgcccggcccaaatagtctaaattttaataaatactgccaaataacactttcaaaagagtatccattcatactcccaccaatggtacataaaaagtctcaataacaattggtaaaattggtttggtggggaattcaactctacactgctgagctgctgctatttgcaaccatagaatcttttttttttttttcttctgagacagagtctcgctttgtcaccgagactggagtgcaatggcgctatcaaggctcactgcaacccttgcttcccggctttaagtgatcctcctgcctcagcttcccgactagctgggattacaggagtacgccaccatgcccagctaattttgtatttttagtagagacagggtttcaccatgttggccaggatggtctcgaattcccgacctcaggtgatctgcccgccttggcttcccaaagtgctgggattacaggcgtgagccaccgtgctgggccctgcaaacatagaatcttagagttgaaagggacataaaaatccatcgaattcttgtccaactcccctcccaaggcagcaatcccctgcaatacagccttgtttacaacgctgttgtctgtgactggggtcaaactccacatctttgatcttaagaataaaccaccactgacagtgggcttatcacatccagtaagtttgttatatcactgggccaaaatctactttcctggtggggcccggtggctcacgcctgtgatcccaggactttgggaggctgagtagggtggatcacctaaggtcaggagccagagaccagcctggccaacattgcgaaaccccatctctactataaatacaaaaactagctgggtgtggtagtgcatgcctgtagtcccagctactcggaaggctgaggcaggagaatcacttgaacccaggaggcggaggttgcagtgagtggcgatcactgcactgcactccagtctgggtaacagagcgagacacacacacacgcacacgcacacgcacacgcgcgcgcgcacacacacacacacaccctacctttcctgcaacacaccccacctatcctagctcagctctgggaagtaacacaaaagagctaatccttttccacatgacagcccttaaaatatttgaagactgtatcacatttccccagagccttctttttgtggggtacaacttcccagttgtgaccaaacacgtcccttccataggaaagtgctgactggagtctcttcagctgagtggcccagcataagagctttagagtcactaggcttgggttcaaggccatgttcccaccccttccagccacctgacctgggctaaatcacttctcagactagtttcctcccttggataaactgcatagcaataatacccatgtcatagggttgctggtttggccacattatgattttttttctttttgagacagagttttgctcttattgcccaggctggagtacagtggcacagtcttggttcactacaacctccgcctcctgggttcaactgatttttcctgcttcagcctcccgagtagctgggattacaggcacctgccaccatgcccagctaattttttgtatttttagtagagtcggggtttcaccatgttggccaggctggtctcgaactcctgacctcaggtggtccacccgccttggtctcccaaagtgctgggattacaagtgtgcgccactgctggccttttttttttttttttttttttttttttttgagacagagtcttactctgtcacccaggctgaagtgcagtggcatgatctcggctcactgcaacctccgcttcccaggttcaggtgattctcttgcctcagcctcctggtagctaggactacagacacccggcaccacactcagtcacatggatttttttggtgggttccttcctccataagaaaaaaagtgttttaaatcatattttatgactgtgttagtataaggatgaatataacaaggcctggtgcagtggctcatgcctgaaatcccagcactttgggaggccaaagtgggagaattacttcatcccaagagttcaagaacagcctgggcaacatggcaagaccctttctctacaaaaaataaaaaatataaaaattagccggaagtggtggcatgtacctgtggtcccagctcctcgggaggctgaggtgggaagactgcctgagcccagggggtcaaggctgcagtgagccatgattgtgccactgcactccagcctgggcgccagagctcctgctcaaaaataccaaaaactaaaaactaaaaataatatatatatgtaataaaggcagggttatgtttattttttcttctgattttaaaagaagtaaaacattttcatggggccctaaaagtattgtgggccttaggcatcatgccttctgtaagttcataggccctggctgctggaaggagtaaaaaagaaaaaacatgccaaatatgtaaagtgcttagcgcagcactgggcctggctctttgtaacttaataaatggtgatcaaaaattaaaaagtgcaatgcaggccgggtgcagtggctcacgcttgtaatcccagcactttgggaggccaggtgtgcggatcacgaggtcaggggtttgagaccagcctggccaacatggtgaaaccctgtctgtactaaaaaacacaaaattaaccaggcatggtggcacacacctgtaatcccagctacttggaaggctgaggcaggagaattgcttgaacctgggaggtggaggttgcggtgagtcgagatcacaccattgcattccagcctgggcaacaagagtgaaactccgtctcaaaaaaaaaaaaaaaaaaagttgggggtgtagtgcagagaacagagtgtaaccctggagaactctgcagagctttccttttttttttttttttttgagacggagtctcgctctgtcgcctaggctagcacaatctcgactcactgaaacctctgcctcccgggttcaagtgattctcctgcctcaccctcctgagtagcggggattacaggtgcatgccaccatgcccggctaattttttgtatttttagtagagacatggtttcaccatattggccaggctgctcttgaactcctgacctcagttgatctgcccaccttgacctcccaaaatggtgggattacaggcatgggccaccacacctggcctgcagaactttctttattggcatgcattgggacttgcagactcagcttcagctgaatgtaaggaacagttcctgggtccatgttttctcactgtgttcacagagtcttgcaagagattctgcaaaaagacacacagtctatggcatttatcttgagacgagagaaagtatacatttaaggacatgtgcgtgaagaattctggaaggataaagaagatattaatttatagccattacctattgagaaggaaggattgggaatattgtgaataggtccaggagtgggagagagactttccactgtatgcctactgatagttttgatgtgtaaacaatgataatagagtgctgattcaaaaatgttaataattttttttttttttttttttgtgatggagtctcactctatcacccatgctggagtgcagtggcgcaatctcagctcacttcaacatctgcctcccgggttcaagcggttctcctgcctccacctcctgagtagctggaataacacttgtgcaccaccacacccagctaatttttgtatttttagtagagacagggtttcgccacgttggccaggctggtctcgaactcctgacctccggtgatctgccagcctcggcctcccaaagtgctgggattacaggcttgagccactgcacctggctcaaaaatcttagtaatttttttgactgtcctaaattgtttattaggtatgagttttacaaactttacttatattagtggtaacagtggagattgagagtattgcgccttctccaagctgcccggcaagaaccaccaatagtgtggtggaacttacggccctttccaaggccatggctcttttggcctgcacatgccagcccacgcatctccttgtgcttgtggactggtttggtgatccactgggtgtcaggatttcttccaatagctttatggaatggatcaatgaggataacctcaaaaaatttgtgtgtggaatcttcacccatccagtaagaattcaggactcttagagccccacagtggcgtccaactcactcctctgcaatcaactgtaggcttcagttaataccatgatggacaggcttgccgtaagttgcacccttaggaactgagcattttcggccatcacggagaatacgaatcccgtagataacataaccttgcttgatcttgtagcccagttggtgcactttatcgggccgggtggggcggggagccctgtggagagcagagagctggcggtactgccagcagcggaccctcagaagaaagctcatgacatcagactgcttcttcctccacagctcgtggatgtacttgtatgcacccatcttggcttacctgattgctgccgccagacagaagggccaaaaatcttaataatttttattttgaaaaatatatgcatgtggttagaaaaaacttcaaacagttcaaaagggtgaaaagcaactctccctcttgtacccagggagtacctggtaagatataacatctcatacaggacttacagaacctctataaaaactattaaaaaattttgttgagagacagtaaagaagacctaaataaatggagagatatacatgttcattgattggaagagcctagatttgaaggcgccaactcttgtattgattcatagatcaaatttaatcccaatgaaaagctcagcctttttttttttttttttttttttgcagaacttgacaatctgattccaaaactgataggggaataaaagggagtcaaactacccaagacactcttgggaggaaaaaacaaaaccaaaaatgaactgtgggctgggcgcagtggctcacgcctgtaatcccaacactttgggaggccgaggcaggtggatcatctgagatcaggagtttgagaccagcctggccaacatggtgaaaccccgtctctaataaaaatacaaaaattagctgggcatggtggtgggtgcctgtagtcccagctacttgggaggctgagggaagagaatcgcttgaacccaggaggcaatggttgcagtgagtcgagattgtgccactgcactccagcctggcaacagagcgagactccatctcaaagaaaaaaaaaagctagacatcaagttagggagaggaagacaaaccagaacccacattcctttttgacgctgttgtttacttttccattatagccattctagcacaattagagtaatatcttattgtggtctgttgaaatactttagaggaagttacacagatcatgatagattactttaaatgccatgccatatatctctaaaaatacacgtttatgtattggaagactcaatattgttaagatggcgatactactccaaagtgatctatagacttgatgtaatctctatgaaaatcccaatgtccttgtttgcagacctggaaaattcaaacctaaaattcacatggtatcgcacccaacagccaatcttgaaaaatgagcagagttggaagactcacacttggtgacttcagaatttactacaaagcaacaataatcgaaaagtttggtattggtaggaagataggcatatagattagtggaatagaatcgagagtctggaaataacccatacatctatggtcaattgttttgttttgttttgtttttttgacagagtctcaccctgtcacccaggctggagtgcaaaattatcacacctgtaagttccgaaattttttctcttattatttcatctacagctttttttcctgtgttttgtcagttttatttttctgaaatgcttattatttagatgtgggatctttttgtgtgaccttctaatgttctccattttctctgatctctgcaagatttcagcaatttctttcttcttcccttttctttttttacttcttgctttcttaatttctgagagctcctttttgttccctgaatgtttcttttaaaagatatactggtcgggtgcagtggcttacacccgtaataccagcactttgggaagccaataggaggatcgtttgaagccaggaatttcagagaagaattctgcaatctcctcattgaaggttgtggtagtcatacctgaccctgtgaataattctaaccaaggctgggcatggtagcttatgcctgtaaccccagcactttgggatgctgaggcaggtggatcacctgaagtcaggagtttgagaccagcctggccaacatggcgaaaccccatttctactaaaaatacaaaaattagctgggcatggcagtgcatgcctgtaatcccagctacttgggaggctgagggaggagaatcgcttgaacccggagctgagatcatgccattgcaccccagactgggcaacaaaagtgaaattccatctcaaaaagaaaataaaataaaaataaaaaaattctaaccaatgaggtatgattgaaaatgacacacgtctttgccaatcatacttcattggttagaattattattattatttgagacagagtctcactctgttgcccaggctggagtgcagtgttatgatctcggctcactgcagcctctgcctccctggatcaagagattcttctgtctcagcctcccaagtagctgggattacaggcatgcaccatcatgcccagttaattttttatacttttagtagaaatggggcttcactatgttggccaggcttgtcttggactcctcacctcaggttatccacctgccttggcctcccaaagtgctgggattacaggcgtgagccaacatgcctggcctggttagaattattcagagaataattgaacaattattctgtgaacaacctgtaaacgaacaacctgaaaattaaactaaggaaagaaaattaagacaatccacttgcaatagcaccaaaaacaataaaaatacttggtaataaatttaacaaaagatgttcaaaatttgtacactgaaagccatgaaacattgctgaaagacattaaggaagacctaaacaaatagaaaaacatcccatgtgcatggattagaagactcaatattgttaagatgtcaatactacccaaagcaatcaacagatttaatgcaatttcattggtcttttctgcagaagtggaaaggctgattctcaaattcacatggaattgtaaaagactccaaacagccacaacattcttgaaaaaaagaagaacaaagttggagggctcatatttcttgattttaaagcttactacaaagctacagtaatcaaaacagtgtggtattagcttaagaacagacatataaaccaatgaaatagaattgagagtccacaaataaacctatacaattatggtcaattgatttttgacaggtgtgctaagacaattcaatgggagaaagaatagccttttaaaaaaattgtcctaggaccactggataaacatgtacaaaaggatgaagttggaccctaaccttgcaattaccttaaaaattattataaatataagaactaaaactataaaactctcagaagaaaacacaaggatgaattttcatgatcttggacttggcaattaattcttagatatgacaccaaaagtacaagccaaaaaagaaaaatagacaaattagacttcatcaaattaaaaacttttgtgcattgaaggatattattaagaaagtaaaaagacaatgtacagaatgggagaaaatatgtgcacaccatgtatctgataaaagtctatgttttaatgtaattaaaacatgaacaaagttaatttgtgcggcagcaataaaaaagggaaacaaatatgaacaaaggacttgaatagacattcctagaagatacgtaaatcaccaacaggcacataaaaagatgttcaacatcattagtctttagagaaacacagacaaaaaccacagtgaggtctcaattcacacacactaggacagctacaatttttttttaaagtgtgtgtattggggggtgcagctgggaacagtgactcatgccagcactctgggatgccaaggcaggaggatcacttaagtccgggagtttgagaccagcctgggcgacatagcaagactgccatctctccaaaaaattaaaaaattagctgggagtggtggcacacccctgtggttctagctacttgggaaactgagtcgggaggattgaacccaggagtttgaggttgtagtgagctatgatcatgccactgcattctagccagagcaatagggtgagatcctatctctaaattacataaataaataaataagtaaatatgcagaaaataacaaatgctgacaggaatgtggagatattggaacactcatgcattgctggtggaaatgcaaaatggttcagctgctgagaaaaactgtttaatgattcgtcaaaaagttaaacacagaattaccatatatctcagcaattctactcctagaatattcacaaaataaatgaaaacatgcactcacatagatgcacatacacacatgtcgacagaggcactattcaccgcgccggacccaaaacatgtattttcttaggaacaccagatagcacttcagtgctatgcttgggggccatttcaaacagcaaaatcaataataaataccacagaaatgtgaaacctatggcacacaaatgctgcaaaaaggacatttgtggcctggcgcagtggctcacgcctgtaatctcagcacattgggaggccgaggtgggtggatcacctgaggtcaagagttcaagaccagcctgaccaatatggtgaaaccccgtcgctacaaaaaatacaaaaaatagctgggcgtggtggtgggcacgtgtaatcccagccactcgggaggctgagacaggaggattgctcaaacccaggaggcagaggttgcagtgagctgagatcgagccactgcactccaacctggaagacagagtgagactccatctcaaaaaaagaaaaaaaaaaaaaggacatttacaataggacagctgaaacaagaagtcagggtgtggcctcattcaacctcagataggaacatgtgtgttgagcaactcaaattttcttcttttttatttgagacgcagccttgctttgtcacccaggcccaggctgtcccaggcccaggcagtgacgtgatctcggctcactgcaacctctgcctcctgggttcaagtgattctcctgcttcggcctcttgagtagctgggattacaggcacccaccactatgcccaactaatttttgtatttttagtagagactgggtttcgccatgttggccaggctggtctcgaactcctgatctcaagtgatccgccagcctcagcctcccaaagtgctggggttacaggcgtgagccaccgcacccaacccttttttatttttattttcatttttttgagacagggttttgctctgtcacccagactggagtgcagtgatgccattgtggctcactgcagcgtcaacttcccaggctcaagtgatcctcccagcttccaaagtagctgggaccaaaggtgtgcaccaccacagctggctaattttttttgtctatttttggtagagacggggttttgccatgttgctcaggctggtctccaactgctgagctcaagtaatccacccacctcagcctctcaaagtgctggcattccaggtgtgagccatcacgaccagccagggatctcaccattcttaagtgcctctcattgaattctcctgttgatagttgcattgatttctcactccttcttctactctgtctcttgctacatctggaccctctctcattcattttctcaaagacattcatctagaatgtctaatttttgtggttgggatcaatacagttcacttgctttatggggtgggaggagtgtaacttttctttaaactgaattctaagcagttttcagttttaactcactacagtctccatgctatattctgaatgtttatatcccccaaaattcatatgttgaaatcctaacccctaaggtgatggtattaggaggtgagcctttgagagatgattaggtcttgacagtggagttctcatgactgggattagtgcccttataaaagggaccccaggctggatgtggtggctcacgcttgtaatggttcagctaccaaggcccccaaagtgttgagatcgcttgagcccagtggtttgagaccagcctgggcaacatagtgagacgacatctccacttaaaattgaaataataataaataaataaaaaggaccccagagagatcccctgccacttatcataggaaggcacagtgaaaagacagctatctagaaaagcaggtcctctccagacacttgaatctaccagcattttgatcttggacttcggtaccatgttacaacagccatacattgtgctactgatattccatatataattgacattttcagggttttttgttttgttttttgtttttttgttttttttttttttgagacaaaggctcgctctgtcgcccaggctggagtgcagtggcacgatcttggctcactgcaacctccgcctcccgggttcaagtgattatcctgcctcagcctgttgagtagctgggactacaggcatgcaccaccacgcgcagctaatttttgtatttttagtagagatggggttttgccattttggccaggctggtctcgaatgcctgacctcaagtgatctgcccaccttggcctcccaaagtgttgggattacaagagtgagccaccactgcacctggtctcttttctattcgttttgttttttgtttaaataaagacaggggtctccttatgttgcccaggctggtctggaactcctgacctcaagtgatctgcctccctcaccctcccaacgtgctgggattacaggcatgaggcactgaaactggcagaatttgaaggtgaggatttgggcttggcagggaaagtccacgcagagcagagctatgaggaagactgaagcccaagcccaaggtctctcatgacagttaggccatttttggtaaaagatctgaaagtctgaatttggggatcctgtaaataaaacgttcatgggtagggctgaatccaggatgcaaatgaagccatcatgagtctgtttttctccctttcttgacttctgcttgccgtttgttggccccagcctcaggcttcatgtagcagggacacgatggatgtcattcaggtacctgggtcccctcagacttccagtgagaggagtcagaagcaagactctctttccccatattctttttttttttttaaagacgaagtctcactctgttgccccaggctggagtgcattgacaccatctgggctcgctgcaacctctgcctcctgggttcaagcgattctcatgcctcagcctcccgagtagctgggattacaggcatgcgctagcacgtccggctaatttttgtatttttaatagagacggggtttcatcatgttggccaggctggtctggagctcctgacctcaggtgatctgctcgccttggcctcccaaagtgctgggattacaggcgtgagccaccgcacctggcttctttccccagattcttagcccaaattacattgtgactcttgggctgtgactaggtcacatgatctctttgaaccaatcactgtgtccagatgaatgcaatgcactcattgtctaaggctgggaacacattttgggcacagggaatggcctttcaaaactgtacatcaaatcatgtccctttccagtctgaggtcctatccagcaatgattctcaaccaggtcgagtttgccctcccaggggacatttggcaacgtagggaggcatttttggttgtcacaacgtcagggtgtgtgtgcaggtacattcctggcatttggtgggtaggggccaggaatgaggctaaaacatcctgcaatgggtcaggtatgttggctcaaacctgtaattccggagctttgggaagccgcggcaggaggattgcttgagcccaggagtttgacaccagcctgggcaaaatgacaaaacaccatatctacaaagaaaaatacaaaaattagctaggcatggtggcacgtgcctgtggtcccagctactaggaaggttgaggcaagaagatcccttgatcccaggagtatgaggctgtcgtgagctctgatcatgccatgccactccagcctgggtgacagagggaaaccctgtctcaaagaaacaaacaaacaaacaggccaagcatggtggctcacacctgtaatcgcagcactttgggagcctgaggcaggcagatcgcttgagccaggaggattgcttgagcccaggagttcgaggctgcagtgagctatgatcacaccactgcactctgcactccagcatgaacaacagagcaagaccttctccagaaaaaaataaaacccctcaaaaccagacaaagatatctgcaaagataacaggaaataatatttctcccaaggacactgcagctgtcaagtgccatggtgacttcctactgtgaaccactgctttctgacttgctgagaaactttgttccaggaaatcatagataatttgcagtttgaaaatatatcagtgcaggccgggtgcagtggctcacgcctgtaatcccagcactttgggaggccaaggcaggtggatcacctgaggtcaggagttcgagaccagcctgaccaacatggtgaaacccccgtctctactaaaaacacttaagttagccaggcatggtggcgggtgcctgtaattgcagctacttgggaggctgaggcagaactgcttgaccctgggaggtagaggttgcagtgaactgagatcgtgccattgtacttcagtctgggcgacaagaccaaaactctgtctcaaaaaaaaaaaaaaaaaaaaaaaagaaaagaaaaaagaaaagaaaagaaaatatgtcagtacaaatgaaattttttcttcttgcttggaggatctgggcagttggatacccaggcacagcaattcagataagggttccctgaacaaagtggtccacatttactaaactttagaagttaatttttgcctttgtttggtgaagcaacccacagctgctcagttgctctggtgtccctctccctccttttttttttttttttttttttgagacagggtctcactctgttgcccaggctgcagtgcagtggtgcaatcacagctcagtagaacctctacctcctgggctcaagcaatcctcccacctcagcctcccgagtagctgggaatacaggcatgtaccaccatgcttggctaatttttgtattgtttgtggagatggggttttgccatgttgccccagctggtcttgaactcctagcttcaagtgatcccccagcctcggcctcccaaagtgctgggattataggcgtgagccaccatccagcctttccttgttttcaataaatgaataaacctgactttctcactaaaggttagtccctggtggccaggctggtctcgaactcctgggctcaagcaatcctcccacctcggcctctcaaagtgctgggattatatgtgtgagccatcacgctcagcctcatttatgtatttgttatggctgcctttgcactcccatgatagatgtgagaaatggtggcagagactgcagggcctgcaaagcctaaaaaatttacaatctggctctttacagaaaaactttgctgacccctggtctaaatgttctgagtacataagtgagcaaaacatagctaaatccctccatcatggagctgaaattctagtgggaaaaagaaaaggatttacatacttacaagacaccataaatacatctagtatatgacttgtatataacttagggtaattaaatggtaagaaaagaagtggccgggcatggtggctcacacctgtaatcccagcactttggggggccgaggtgggcgggtcacctgaggccaggagttcaagaccagcctggccaacatggcaaaaccctatctctactaaaaatacaaaaattagctgggcgtggtggtgccaacccgtaatcccagctgctcgggaagctaaggtgggaggaagcaccatgcccggcctgcttccactttttggctactgtgaataatgctgttgtgaacatgggtgtacaaatatctgttcaaacccctgctttcactacttctttttttttttttttgagacggagtttcactcttgatgcccaggctggagtgcaatggtgcaatcttggctcaccacaacctctgcctcctgggttcaagcgattctcctgcctcagcctcctgagtatctgggattacaggcacgcgccactgtgcccggctaattttatatttttagtagagagaggatttctccttgttggtcaggttggtctcgaactcatgacttcaggtaatgcacctgcttcgggatcccaaagtgctgggattacagacgtgagccactgcgcccggcctctcttattttggttatatacctagaagtagaattgttgtatttttttccagcaggattttataccaaggacaaagggaggccatgggaagctgcatgcagggtgctttactaggtcccctggggctgctgtgaggcattctgattgtagtggggaaagaaaggaagtggggagaccaaggaggaggtaggtacagaagttcaggtcacaggtagcagcagcttcaaggtcccaatctgggccaggcgctcacgcctgtaatcctagcactttgggaggccaaggcgggcggatcacttgaggtcaggagttcaagaccagcctggccaacatggtgaaaccccgtctctaccaaaaatacaaaaattggctgggcgtggtggtgtgtgcctgtagtcccagctacttaagagactgaggcaggagaatcgcttgaacctgggagatgcaggttgcggcgagccaagatcctgccactgcactccagcctgggcgacagagcgagactctatcttaaaaaaaaataaaaataaaattaaaaaaatgctctcagtctggcaggggaggccatatggagcaaataaataaatgaatgattacaaatagtgaaaagtactcctaaataaatgaacaagaacagagtgctgtgattacaggaaataaaaagaggaactctggcattctctgtgctacctatcagtttagtgatgcttgaaatccaaaattcaaatcttgcattttaatcatgaatcactttgctgccagttgagtgggtttgatgcagggccgagtctgttggtctaagggtttgttacattgtgagagcccctaatggggaggaaggggcttagaaataaggcaaagggggtggtttgagcctgtggctgaaagagttgcacagagaggcttggtggttaggagcagagctgagccttatctctgccacatcccagctgctggatctgcaacaaattacttcttccctctaaacccagtttccgcttttggaaaatggtagactaattggtttggtctataattacttccttctttgttttggtcactcctgtgtctacagcacctaatacagtatccggcacacaggagactcgcaataaatttctttcttgcttttctttctttccttgtctttccctccttccctccctcccttctttctttctcgctgtctgtctttctcgctctttctctttctttctttctctctctctcttttctttctttctctctctctctttctttcctttcttgatggagtctcactctgtctctgagactggagtgcagtggcgccatctcggctcacctcaacctctgcctcctgggttcaagtgattctcctgcctccacctcctgagtagcttggattacaggcatgcgccaccatgcctggctaatttttgtatttttagtagagacggtgtttcaccatattggtcaggctggtcttgaactcctgacctcaggtgatccacccgcttcggcctcccagagtgttgggattacaggcgtgagccaccgtgcccgactctcgtttatttattttctattttaaaaattttaattgaggctgcgcacagtggctcatgcctgtaatcccagcgctttgggaggctaaggcaggagggtcgcctgcggccaggagttcaagaccaacttgggtaacgtagtgagatcccattttacataaatattgcaaaaaatgttagtcaggcgtggtggtgtcccccatagtcacagctacttggggggctaaggcaggaagattgcttgagtccaagagtttgaggctacagtgagcacccactgctctctagcctgaagaacagagcaagagcaagatcatagctcaaaaaaatttttttaattgagtttaactttcatagagcaaagtacagcaactttaaatgtcctcttgatgaagttttttttttttttttgagacggagtctcactctgttgcccaggctggagtgccgtggcacgatctcggctcactgcaatctctgcctcctgggttcaagtgattctcctgctgcagcctccagagtagctggcattacaggcatgcaccaggacacctaatttatgtatttttagtagagatgcgggtctgccatgttggccaggctggtcttgaactcctgacctcaagtgatccacccaccttggcttcccaaagtgatgggtgggattacaggcatgagccactgcacctagccaagctcaatgaattttaaaatataaatgtgtgtgtacgtgtgtgtgtgtgtgtgtgtgtgtgtgtatatatatatatatatatatatatgtttaaaaccacataactaccaccaaatcaagttatagaacatttacatctccctaggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggaccacaggtgtgtgccaatatgcccagctaatctttaaaattgttttgttgaggcaggcatggtggctcacgcctgtaaccccagcactttgggaggccgaggcaggtggatcacaaggtcaggagtttgagaccagcctggccaacatggtgaaacgccgtctctactaaagatacaaaaaaattagccaggcaccgtggcacgcacctgtaatcccagctacttgggaaactggggcaggagaatcacttgaacccggaaggcagaggttgcagtgagctgagatcatgcctccgcactccaacctgggccaaagggagagagtctgtctcaaaaaataaaaaaaaaaaagaaatttgttttgtagaaatgaggtctcactatgttgcccaggctggtctcaaacttctggcctgatgagcaatccgcctgcctgggcctcccagattgctggtattacagacatgagccacagtgcctggctcttgaataatgtatattagttttgcctattgttgaacatcgtgtaaatgagatcatggcaaatatgctcttttgtgtctgccttgttttgctccttgttgtgttttgtgggattcatacatattgttgctattatgaacattttttgtagatgtgttttggtggatgtaagctcacctttcttttggaggcgagtggaatttctgtgtcactatgtaattgtatgtttcactttagcacgaattattagttttctttcttttttggagatggagtctcactctgtcacctaggctggagtgaagtggtgcgatcttggctcagagcaacctgtgcctcctgggttcaagtgagtgttgtgcctcagctccccaagtagctgagactataggcatgtgccacaacgcccagctaattttattttattttattttacttttgagacagagtctcactctgtcgcccaggctggagcgcggtggcgcgatcttagctcactgcaacctgcgcctcccaggttcaagcagttctcctgccttagcctcccgagtagctcggattacaggcatgtgccaccatgcctggctaatttttttgtattgttaatagagatggggtttcctcatgtcagccaggctggtcttgaactcctgagctcaggcaatccacccaccttggcccacctttttgtattttttgtagagatggggtttcaccatgttgctcaggctggtctcaatctcctgagctcaagagatccacctgcctcggccacccaaagtgctgggattacaggcatgagccactgcacccagccaaattgttagttttccaaagtagttaagccaatttatatacctcccaacagagcgtgccttttccagttaatccacgtctttgtctgcactcgtaattttcagtctttgtttccagtcactctggtgggtgtatgatggtatttcactggggttttatttgcatttccctgatgactaatgaagttgagcatgttttcatgtgcttgctcaataaatatttgttgaaaggatgaataaagagtgaatgaataaaacatggaaagaaatccaactctgtcttgtgccctgcctaaaacccaccagtggttcccactgcccctcctttggccgacgggtacctgcctgccctggctccttctgaccccacctgctccggatggatttcttttgcttcttctctgggttcctgccatccaggctgtcttcagtttcctccaaggaccctccctgcttcataactttgctataaactgttttcttctgcccagaacacaacccaggcccaaggaacccagacgcgttccttgtatctcagtttgaaagcctcttcctccaggaagccttctctgacttccaccccccagcaagggtggtataaattgctaacttaggcccacttttgcccactttttttgtttgtgtttttgagatggagtcacactttgtcgtccaggctggagtgcagtggggccatctcagctcactgcaacctccatctcctgggttcaagtgattctcctgccttagcttcctgaatagctgggattacaggcacccaccaccatgtccagctaatttttgtatttttacatttatttatttatttatttgagatagagtattgctttgtcgcccaggctggagtgcagtggcatgatcttggcttactgcaacctccgcctcccaggttcaagtgattctcctgcctcagcctcccgagtagctgagcctgcaggtgcctgccaccacacccagctaatttttgtatttttagtagagatggggttttaccatcggtcagactggtctcgaactcctgaccttaagtgatctgcctgccttggcctcccaaagtgctgggattacaggcgtgagccaccatgcccggccaccactttttttttctagctgtgaccatagttgtacatatctccccttccctggcttttttttttgttttttttttcctgagacaggatctcgctgtgttacccaggctgcagtgcagcggtgcaatcatagctcactgtagccttgaactcctgggccaaatgagcctcccacctcggcctcccaaagcactgagattacatgcgtgagtcactacttctggcctgtaaataccctttcaaaaatataatatttgattaacatctgccatcttaccataagaaacacttaaaaaaatcccaatccaaaaaaattccaatcctttaagctatataagagtagcaattttatcttgttcctagcaagacatctggcatatagtaaatgctcaataaatatttgttgacagtataaaggtcaagcaacagcataactggcattattacatgaaagtaattatcccttagaaactcattcacccttgggggacccgggccaataaaaaaatcacagaaaacaatcctatctaccttcctccttcctccttccctcgctaggtcctttgattggggggaggtctcaaatgcacacactgtttctgttttatttggtgcagctgttgtgtgcatgtgttatggaaacccacatcaggcaggagattaaggaggagaggagaaaagaaaggcatcgctggtatcacagtgaaatttacactctgcggcctcgccctagctcctctgtctctacctgtctgcctatgaaacagttcaaaactaatatggcgcaatggatggtattatagacttcccacctccctggccagacttcttgggttcaaagtttggcttaatcacttaccatctaaataatccctgacaatgtactctgtctttctgggccttagtggcctcatctgcaaaatggggataatactacttcttacctcatggggttgtgaggattgcacaagttaatttgtgtaaattgctaagaacacagccttaggaagccttgtcactgtgaatgcatattaattttttttattattattttttgagacagagtcttgctctgttgcccaggctggagtgcagtggtgtgatctaagctcatttcaacctccgcctcccaggttcaagtgattctcctgtttcagcttctcaagtagctgggactacaggtgcccgccaccatgcccggctaatttttgtgtttttagtagagacagggttttgctatgttggctaggctggtcttgaactcctgaccttatgtgatcggcccgcctcggcttcccaaagtgcttgattacaagcacgagccaccatgcctggcctacgattatcatgtctccaggcttcagtttccttacctctgaggtgaggatcaataacctggttatttctaagtgatgcttaaagaggttgagaagaagcaaaggcgctctgcacacaggtgaggtcaacagctgttagtgatggagactggcgccgtctgggtcatcagtgctccggaatcaggctgctcacgggtttgaatctcacttccactttcactccttattaactgtgtgacctcgggcaagtcacttcgcctttctgaacctcagtttccccatctgtaaaaggtaggtgaataacagtattcacctccttctgtgtgactcagctttggagtcagcggaccgggttcaaatcccagccctgcaagtgattagccaggtgaccctgggcagagggaatcactcaacctctctgcacctgggtttcttccttcatgaacgtggagactttacaggatgaaatgagggcacagttaaggcgcccggtacactccaggcaggtagggggctccgttcacgttattttcccctggtgacggatactgtccttaaacagcatttgaaaagtggtcgcagggtgtgtggccccaaagatcccaggcgcttccggaaggcgagccaacgctccccaggcccgtccgcgagcgggtgggcctaagccttggaggatctggggtgggggtggcgcggggtccaggcccggggcgccgagaggtggctggtccggctgcccacgccgagacgcgcgaggtgagcgggcgccggggcggggcggggtggggcggggccgccgcatccccgtgacgcgcgggccaaccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggtacgtgccgggggccgcgtgaggccggcgggacggagggaggccggcggggagggaaagcaccgggcccgcagccgcccggggcaccccgctccccgctctgctgccggcctcgggggcccgggaccctcacgtcgcccgcggcccagcccctttcgggggtgcaaggcatgggggaaacttgggtgactcagttcctgcggagcagagcgtggggggccgcgtgcccagccctggggttttggagggtcgggtcgggtcagagccgccgtgaggaggccttcctgttttggggttcccgtctgtaaaaacaaccttccagggaaggggacgctagagatggggggcgggaagaggggtgtctctctgcttctgttttcccatcttttttgtggttagggtccccccttttcacgaaaaatactccgtgaccaacggggtgagctggggaggggcttagattgtagaaagggactttcattgtctccccaaagttgtcgtacaagccacattactcttctgtggttacctagctttgttttttttgttctttctacttagatactgcgggggaagtttgggggaaccagggaagaagggggatgtccacccttgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgtatttctgctgtctggattccaagacttgttggaggtgccttggaaccagaatttgagaggaggcaactggggcctgagtgggaaaattgaaatataattaactgaaagctagaaagtaggtagttgttgcttttttcttttcttttttttttctttttcttttttgagacagagtcttgctctgtcacccaggctggagtgcagtggcacgatctcagcttactgcaatctctgcctccccggctcaagtggtcctcctaactcagcctcccaagtacctgggactataggcgtgtgccaccacgcccagctaatttttgtattttttatagagacagattcgcactatattgcccaggctggtctcctactcctgggctcaagcgatcctcctgccttggcctccaaaagtgttgagattacaggcatgggcctctgtgcccggctgtttttgtgtttttcaaggtagcgtgtccgaggccaggagcgactggcctcccaggcagtcagataactgtgtgaccttgagcaagccactttccctctgtgtgcctcactttcctcatctctaaaattggacaggagccaaaaatgtggcagccttcttgggttgttgcgaagggtcaatgagttaatcttgtaagtggctcagcttgtgccctgcacggagataaacaatggttagtattaaatattattttttccaaagatgaagttgtgtgttttaagctccttgttcttcctttggattccccttttcttcagctggtggagatgggattgggctgtgaaaaggcagtgaggcacccgtgcctggctcctgttgtgaccaaggtcatgtgcttagaagtcaaggtcagtgggcctcgggtgactctgtcagagctttgtttctgggctactgtctgcctctgagccgcaggaaatgtccagaaaacccagaagatggaaatggcccatgataagtgttctgttgacctttactcagacagatgctctgggaagagaaaaggagaactttgctatcaaaacggaaaatagggcctgaggacaggtcacagcagcccttggctttcttttctcatgggggtgggactggtaggaggcgctgctttgtggttgatattggcatgatggttggaaaaatgggcctgggactttttgtgagttcattaaaaaaaaaaaaaaaaaaaaaaaaaaaagcaggccgggtgcagtggctcacgcctgtaatcccagcactttgggaggctgaggcaggcggattgcttgaggtcaggagttcgagaccagcctaggcaacatggattgacccccgtctctactaataataccaaaaaaaaaaaaaaagcctggcatggtggtgtggcacctgtggtcccggctactagggaggctgaggcactagaatcacttgaaggctgtgggggtggaggttgcaatgagctgagatcacggtcactgcactccagtctgggccacagactgagaccctgtctcaaaaaaaagagggccgggtgtagtagatcatgcctgtaatcccagcactttgggaggccaaggcaggcggatcacctgaggtcaggggttcaagaccagcctgaccaacatggcaaaaccccatccctactaaaaatacaaaaattagctgggcctggtgattcacgcctgtaattccagctacttgggaggctgaggcaggagaattgcttgaacctgggaagaggttgcagtgagctgagatcacatcactgcactccaacctgggcgacagagagactgtctcaaaagaaaaaaaaaattgtgcttcaggccctgtgtagaaaaattggaaattatggaaaagcagaggaaacaacttggtattaagcagtatagtgtggtggctcagagcaaattcgcctctgctgctgaggcaggttacgtcatctctccgtgcctcagtttccctatgtgggataacgtagtacctagtgaatagcggtgacttgaggaataagtgagttaatccttagcaaggacttaaaatgttgctgcttggcacacagcgctcagtaaagatcagtggtcgttgccacctggaattctccagttaatttttgctgttgcaccaactgccactggagaagaccagaaggaagctgcaggtgtgtgtcaccgtcgatggagtgagctggtcccagggttgatgtgcacctctgagatgctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgtacgacgagccaatttttcccctcctccaagtgtggctttggttttcaaatccatcccttagccttctcctacttcctctgttttcccctccccaccctttttttttttttttttttgagatggtgtcttgctgtgtcgcccaggctagggtgcagtggtgtgatctcggttcactacaacctctgcctgctgcgttcacatgattcccctgcctcaggctcccgagtagctgggattacaggcgcacagccaccatgcctggctaagttttgtatttttacaaaactttacaaaacccccatagagacggggtttcatcatgttggccaggctggtcttgaactcctgacctcaagtggtcaacctgcctcagcctcccaaagtgttggggattgcaagcgtgagccaccgcgctcagcctgttttccccctttttggctgcccctccttccagacccttcctctctcccttccttatggagtgttagagtggaaagggatgtcagatcttggggggccctcctctccacccaccccatttcgtggatgtggacactgaggtccaggatggtgacatgacagggtgcaaggtggcaaggtgaatggctttgggaggagatgagggtgacccgggagaggcctgggcaggagtggactcaggggttcctggtccaaatgggttcgtgattcaggccaatcaggagcggattcagggttccttggccaaatggagccactgcagccacaggggccctgcagaaggcagctgcagccggtccctttggccaagactctcctgaagggtcgtgttctctttctccgaggacaagttccatttgtgatagcctggagggggtgcctcgcctttgggacctggtggtagatgggggggaagaaaaccttttctgtttgtggacacaacttttaggaactgatctctctatgtgggtgtctcccactgaccatgttcctaaagaacgtgagcttcctcttcccatgtcagtctccagctttgacttctctttttctcctcccattcctatcacatctgtcagcaaatcgtgttgcccgttgcctcaaacgggctgcttttcatggcttccccgacttccactctggctcgagtcatcgttggccagtttctggatttgaacagtcacctcagtccaggcgccgtggctcatgcctgtaatcctggcacttcgggaggccaaggcagacggatcatttgaggccaggagtttgagaccagtctgggcagaatggtgaaaacctgtctcaactaaaaatacaaaaattagccgagcctggtggtgggcgcctgtaatcccagctacttgggaggctgaggcaggagaatcgcttgagcccagtggggttggaggttgcagtgagccgagagttcgccactgcgctccagcctgggtgacagtgagactctgtctcaaaaaaaaagaaaacagccacctgttcgctgctgtgcctactctgcccttgacccctacagtctagtcttggcccagctgtccctcttctactaaaaccctgcagtagttccttgagggtacaagccaaagggcttacagtggcctcgaaggctgggcagcatctgtccccttggcctccctgacctcttctctggctgctttctgtctcactctcctccagccacacttgtggccaggcctgtccctgcctcagggcctttgcacttgctgtttctcctacctactatgtccctcaccttcaaactttgttcaggtgtcacctcaggcatcccgttctttccctccactagcaaatctctgtcccccatctacacccccagtagcacttactgccttctaatacacgtaatattttgcttaagtattgtgcctactctgtaaactcctaccaaaagatcggctccataggggcagggattttggcctgtgtttgtttacggctgtaatcccagcacctagaactgtgcctggggcttagtaaataacagttgaccttggaacaattcaggggttaggagtgctgatgccccatgtagttgaaaatttaggatgcagcgcggtggcttacacctgtaatctcagcactttgggaggccgaggcaggtggattacctgaggtcaggagttccagactagtctggccaacatggtgaaagcccatctctacaaaaattagccaggtgtggtggctcatgcctgtaatctcagcactttgggaggccaaggcaggcagatcacttgaggtcaggagtttgagaccagcctggccaacatggtaaaaccctgtctctacaaaaattagctgggtgtggtggcgggtgcctgtaatcccagctacttgagaagctgaggcatgagcattgcttgaacctggtaggcggacactgcagtgagccgagatcgcgccattgcactccagcttgggtgacagagtaagactctgtctaaaaaaaaaaaaacacaataaaggaaagaaaattcaggtctaactttcaactccctaaaagtttaactactaacagcttactgttgactggaagccttaccgagaacataagcagttgataacactaattctgttgttgttggttgttttttgatagagatggggagcttgctgtgttgccgaggctggtctcaaactcctggcctcaagctattcacctgcctcggcctcctaaagtgctgggattataggcgtgagccactgcacttggcctaactcataccttgtatatatattatatactgtatttttacagtgaagcaaggtagagaaaagaaaatgttaagattaattcataagagagatttttactatttattaagtggaagtggatcatcataaaggtcttcatcttcattgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgtttttttattttatttttttgagacagggtcttgctctgtcacccaggctggagtgcagtggcgcgacctcagctcactgcagcctcaacctcctgagctcaagcaattctcccacttcagctccccaggtagctgggactacaggcacacaccaccatgcccagctaattttttttttttttttttttgtagagatagggttttgccatgttgctcaggttggtggtgaactcctgaactcaggcgatctgcctgccttggcctcccaaagtgctgggattataggtgtgagccaccgtgcttggcagaacagcttctatttcatcttggaaaggtcagaacagggttttgtccacccctcttttcccaggactcagtgtctcacacacagtgggggctcaatcaacattagaatttgagtgtttgaggtatgagttccaagctaggggttagatatagctcaccactgtgctggtttggcttgattttaattataggaatgactgtgatttccaattttatttatttatttatttgagacggagtcttgctctgttgccaggctggagtgcagtggcacgatcttggctcactgcaacctctgcctcctgggttcaagcaattctgcctcagcctccccagtagctgggactacaggggcacgccaccacatccagctaatttttgtgtttttgatagaaacggggtttccagtatgttggccagcatggcctcgatctcttgacctcgtgatccgcccgcctcggcctcctaaagtgctgggattacaggcatgagccactgtggcccgccctacaatgtttattcattggcagatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccatatgttccctggggtgtgaaatcacacagccactggtgtggaggaatatgggggagaaacatggagcaagaccttcctcctcatcctgcatttccctaggaggttgtgggctgtcgaaattctagtgtaattggcttactggggttgccttggagaagcttaatgagacgttaaggaggttaaactccaattagctagagaagaaacttgcggcagtttcttttttactgagggctgtgtctttttacctttttccattttcccagttggagttgtgacagttcattctcccctgggaaaacaaaaatggctttctttttctttttctttcttttttcttttgagacagggtctccctctgtcacccaggctggagtgcagtggcacaatcatagctcactgcagcctcgacctcctgggctgaagctatcttcccaccttagcctcccaggtagctgggaccagaggtgcacaccaccatacccggctaatttttgtattttttgtagagtcagggtctcaccatgttgcccaggcttgtctcaaactcctgggctcaagcgatcctcctgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctctaggcactgaggatacaacagtgaacaggacagaccaggcccatgttctcatggggtttacactgagggtgacggaaatgatttcagatgctggcaagtgctgcaaagacttgaaccgggaaaaactgggtgaggtgcaaactactacggagggatgtccacagaaggcctttcggaggcggtgaggtttgaccccagagctcagtggcaaagctggccatgcaaggatgtgggggaagggagtcccagagtgggaagagaatgtgcataggccttgaggaagatcatggtgtggttaaagtattgaggagtttaactcaaaggaactgcagagcccatctcataaaaatctagcctggagcattcggcaaaatgcataaagcactaacacaatggcttgtggtcctggaatttccagggaaggcgcttaccagctcagcaaggaagtagaacaatgcatggtccctggcagaagcaagaaccttctgatctgtttatgtttgaatgaaacgcaggttttttttttttttttttttttttaaaatagatgggggtcttgctatgctgctcaggctggtctcgaactcctgggctcaagcaatccacccaccttggcccttccatgtgctgggattacaggcatgaggcactacgccctgctgaatctcaggtcttaaaaattcagtttattttgttttatgagtctcttctctttctcagaaccttaactgaaacgtttgtgatcaagaccaacttgggtttccccactccccagttgcctttgattctccgccaaaggcttgttcgtaagatgatgaggtacttttttcctgtggttaagaggactttctataggttgctagaaaactcttgttttaaaacaagatgttgttgaattgatctggctgattgcaggaggaagatcttgtactgcaactttgttgatgatgctaatactttaaggtgaatattctagaagaatataaagggaaaaataaaagttttagtatgttcccaccctgccctttgttcccagaagtagccgttattgatgatggttgttgatgatagtttcttgggtgtttttcgagaaaagtttcaagtatatgcaaatgtatgtgcaagaacgtgttcgtttgtgtgtatatgtttacatattcattttttccctccctagttgggtattttaaatactgttttgtctcttgttctcttcacttaaccagtgttgattttcttgccattttaagcccatgcaaattgaaagtaaaagccaatcaaatcaacttttttttttttttttttttaaacaagccacgcatttgcctgttaaatggctgagccatgtattcacccattcccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatctcatctttctcatatttcaaaacacaattatgccttcccaacagttccccaaagtcttaactcatttcagcattaactcaaaagtctatgtccaaaatctcatctgagacaaaatctagtctctttcacctatcagcctgtaaaatcaaaagaagttagttagttcctagatacaatgggggtacaggcattggataaatacacccgtttgaaatgggagaaattggccaaaacaaaggggctgcaggccccatgcaagtctgaaatccaataggccagtcataaaactttcaagttccatagttatctcctttgactccgtgtctcacatccaggtcacactgttgcaagaggtgggcttccacggccttgggcagctctgcccctgtggctttgcagggtatagccccgctcctggctgctttcacaggttggcgttgagtgtctccgtcttttccaggcacacgatgtagctgcaggtggatctaccattctgggttctggatggtggcccttttctcacagctccattaggcagtaccccagtggggactctgtgtgggggctctgaccccatatttcccttctttactgcattggtagaggttctccataaaggctccacccctgcagcaaacttctggctggacatccaggcatttgcatacatcctctgaaatctaggtggaggtttccaaacctcagttctttagttctatgtacccacaggctcaataccacatggaagctgccgaggcttggggcttgcaccctctgaaggcacagcctgagctgtgtaccttggctcctcttagccatgactggagtggctgggcaccaagtcctaaggctgcacacatcaggggggccctggacccagcccaggaaaccgtttttccctcctaggcctgtgatgggaggggctgctgtgaaggtttgtgatatgccctggagacattttccccattgtcttggaattgggctccttgttacttttgcaagtttctgcagccggcttgaatttctcttcagaaaatgggtttttctttttacattgtcagactgcaaatttccacactttttttttttttgagatggagtctctctctgttgcccaggctagagtgcaatggcatgatctcggctcattgcaacctctgcctcctgggttcaagcaattctcctgcctcagcatcccgagtagctgggattacaggcacccgccatcatgcctggctaatgtttgtatttttgtagagacaggatttcaccatgctggctagactggtctcgaattcctgacctcaagtgatctgcccaccttggcctcccaaagtgctgggattacaggcgtgagccactgcgcccggccaatttccacccttttatgctctgcttcctcttgaatgctttgctgcttagtaatttcttcccctagatgccctaaatcttctctctcaagttcaaagttccacagatctctagggcagggtcaaaatgctgccagtctctttgctaaagcatagcaaggatcaggagaacagcatgggggaaccgtccccatgatctaatcacctcccatgatgtcccttccctaatatgtggggattccaattcagattacaattcaagatgggatttaggtggggacacagagccagaccatatcagtaatctcttgggctaaccaataaccaatgtattcttgtattttttctttgaaattttataaatatttataaatttaaataacatttaaatcaaaatggattatgttgtaatcattactctgccagttttttttttttaatttttaaatttattttttgtagagacaggatctccctatgttacccaggctggttttgaacccctggactgaatcgatcctccggctttggcctcccaaagtgctgggatcaaagtttgttaatttgatagctaaaatatattttcatctgcatttcaattacaattagaagctatgtatcctgcaacatattttccagcaatttgtgtattttcagtgtgtctttctgagtcctttttgggtatgcctggactagtttgtctttttcctgttagtttgtaagggctcttgttattgtgggacctttcctctttgtccatcacctgtattgtataaatattttgttacaggctattgttttcctattggcatattaacatttgagtcttgttcttactagtatgtagttttgcaaggttgcatttgtagcttgcatactgtctcctatgtttttatttactgtaataagtattttcccatgtacccacgtaacctttttaattaaacctataaatgtccaatcgatagttccctgtgttggtgggctataatcacataattattatctgtggtttgacatttgggttgctgtgttttctttctccttttttttttttattattatttttgagacggagtcttgttctgtcgcccaggctgaagtgcagtggtgcgaccttggctcactgcaagctccgcctcccaggttcacgccattctcctgcctcagcctcccaagtagctgggactacaggcacctgccaccacgcctggctaatttttttgtgtttttagtagagacggagtttcaccgtgttagccaggatggtcttgatctcctgaccttgtgatctgcccacttcggcctcccaaagtgctgggattacaggcatgagccactgtgcccagcccctttctccctttttaacttttttgagacagcatcttataccatcacccaggctggagtgcattgcgcaatcttggctccctgtgacctctgcctcctgggttcaggtgattctcctgcctcagccgctggagtagctgggattacacatgtgtaccatgatgcctgattaatttttgtattttcagtagagatggggtttcaccatgttggccaggctggtctcgaactcctgacctcaggtgatctgcctcccaacgtgctgggattacaggcgagagccaccatacccagtcatttttatttttcttttaaagaaaacactgtcctgaataccacatgggtagagtgcgtattggcttatttccttagatgatgttctcaggagtggaatgaataacatctgaaaaggcttcactctagccattgtcttattttctaaaagtgagctggcccagctcaccgttctagcagggtctaaggttacttactgctgtggttattattcagagtggacgatggtgcatgttaatgtcaggcacagcagggcgcggtggctcacgactgtaatcctagcactttgggaggccgaggtgggcggatcacgaggtcaggagttggagaccagcatgaccaacatggtgaaaccccatctctactaaaaatacaaaaattagctggcgtggtggcaggcacctgtaatctcagttactcgggaggctgaggcgggagaattgcttgaacccaggaggcggaggttgcagtgaactgagattgtgccactgcactccagcctgggtgacagagagactttatcttaaaaaaaaaaaaaaaagtcaggcttttctagggttcctccatcagccttgtaaggctggagacccgtggccaggaagaaaattggagctgtctggcactgggaagggtaacccagtagttataattaggttggcttatctgcgagccctttgataaggcttcactaatttactaacccaggatcgcatgttagatcaggatctctctgagtgctgcaattgtagtttgcttttctctctctcttttttttttttttttagagacagagactcactctgttgcccaggctggagtgcagtggtatgatcatggctcactgcagccttgaactcctggcctcaagcgatcttcctgccttaccctcccgagtgtcttggattatagatgcttgtcaacatgcccagctaatttttaattttttttagagatgaggtcttgccctgtcacccaggctggagtgcagtggcatgaacatagctcactgcagccttaaacttctggcctcaagcagttctcctgcctcagccttccaaagtgctgggattacaggtgggcaccactgtgcctggcctgcagtggtttaatagggctctttcatctttaactttggtcccctgccccctgagatccgtggagtgagccgtttgacgcttggtacttgggacaaagctggcctatgtccagttctctgcatacttggtaggggagtgtttggagaaaaggctcacctctgagtcacaccctctatattctccaaagggccatggggatggggtggaggaggctggggtgaagagatgttgtagctccagagaaagccagggaggtgtatgctgggtgaagaggccaagttcaggagcctaggtttgaaaatcagtatagacgattcaggttaattcaccctgttgttatagagcatctgtctgtagggtggccaggtctgggtgagtctcttggacaagatgggtatcaggtttcagctctgaaattggactgatatgtggggagattcattctgcagttttatttgtagtttaggtttaagaaaacttggactgggcactgttgctgtcgtctgatcccagcacttagtgatgctgaagtgggaggatcacttgagcccaggagtttgagaccagcctgggcaacagaaagaccccatctctacaaaataataataataataattattattattattattagctgggcatgatgggacatgcctgtagtcccagctactcaggaggctgaggcgggaggtttgcttggtcctgggaggttgagctgcagtgagctatgattgcaccactgcactccagcctggacaacagcatggcactgtctccaaaaaaaaaaaaaacaacaaaaaaaaaacttgtttaactacctaaatcatagcatttgtgtgaagccagactatcacaactctgagaactgctgacatatacatattttggaagttccaggttttctgttactataaacatggtagagattgaattacttaaagggacgtcttttctcctactctttgtcttgtctgatgttataaggggtacagtatagaatgaaaacagtgcagaaatgagtgaaacatgaaaatcccttctagagataattttcttttattatttttttgagacggagtcttgctccattgcccagtctggagtacagtgatctcggctcacggcaacctccacctcccaagttcaagtgattctcctgcctcagcctcccgagtagctggggttataggtgtgtaccatgcaccaccatgcccggctaatttttgtatttttagtagagacagggtttgctgtgttagccaggctggtctcgaattcctgacctcaggtgatccgcctacctcggcctcccaaagtcctgggattaccggggtgagccaccatggccagcctcttctagagacaatcttattggcaggttgatgtttttaattttcagcctctcttctccacagatcctaaagatatagtaatttttttttttgagacagagtcttgctctattacccaggctggagtgcaggtggcgtgatctctgctcactgcagccttcacctgccgagtagctaggactgcaggcatgcaccactatgtctagctaatttttgtatttttagtagagatggggttttaccattttggccaggctggtctcaaactcatgacctcaagtgatccacctgccgcagcctcccaaagtgctgggattacaggtctaagccaccgtgcccagccataaatacatggtattttttaagaacaagaacgggattctacaaaaacatatatatgtgtattttgagacaggatctcctctgttgctcagggtggagtgcaggggcacgatcatggcccactgcagccatgacctctcaggctcaagcaatcctcccaccttagcctctggagtagctgggaccacaggtgcccaccaccatgcccagctaatattttttcttttttttttttgtattgaaaacagtcagccaggtgtggtggctcacacctgtaatctcagtacgttgagaggccgaggtgggcagatcacttgaggtcagtagttcaaggccaggctgtccaacatggtgaaactccatctctactaaaaatacaaaaattaactgtggtggcgcttgcctataatcccagctactgggaagggggaggcataaggatcacttgaacctgggaggaggaggttgtagagagccaagatgatggcactgcactccagcctgggcaacagagcaagactctgtctcagaaaaacaaaacaaaacatatagtctttatttttttgtttgcgtgggctggtgcatcttgattatgatgcatttttgttaattgatatttaattgcagatgaaatgtaacatggatctgagtaattgctgataattgtttcctctttaggcagctggtcagtcttttttttttttttttttctttttaagagagtttctgtcttgttgcccagactggagtgcagtagcgtgatctcggctcactgcaacctcctttgccagggttcgagtgattctcctgcctcagccccccgagtagctgggattacaggcatgtgccaccacgcccggctactttttgtatttttagtagagacgggttttgccatgttggccaggctggtctcaaactcctgacctcaggtgatcccccctgcctctgcctcccaaagtgctgagattacaggcttgagccactgctcccagcccatagtcttttttttttttaaacctctgtgtacaggtaggtcctggggaaattcgaggcaagacttgggtgagtgggtatcttagaccctctcaggagctctttgcaggaggtagaatctccgagggtcagtgcccatgaatgggtcccatggcctgactggtcccattcaggtgacagtctctgagggtcctgcatagcccttacctgggctccatgctgggaatcgagcggtatacagagcatggttccctgccttccttgagccccagtcttgttggggaaatggccaaataaatgaataatcatcaggaagtgctatgaaggggagctgcgtggtgcccggtgagtgcaatagcggggtttcatctggttggagagaaaaaaggagactccttaagtggggaacccgtttgatgatacaggtttggctatgtgtgtcaaagaccccaaatatagtgggttaagatacaagctcatttctctctcatgtaaaaatcccagctggtgtggcagctctgtccccaaaataatcagggtcccaggcccctcccatcttgttgctctgctgtcctcatctgcatggatcaagatgatgcatctccatgtccacatggcagccagtaggaaagcagagtaagggcacaacctggaggttgcctacgtctctcctcgtcacatcccattggcttgtacctagtcatgtggtgcctctagctgcaaaggaggctgggaaatgtagtttcctttctaagcaggatgtacccagctgaagatgttactcagggatgagggagagttgatactggagcgcagctagcagtttctgctgtataggcaaaagcagaaggtaagaatgttctgggcagtgggaaatgcatgtgcagaagcactggcttaatgaggaaggccactgtggctggagtcaaagagtagggaagagaaaaagaaccagaaggaggctgagaattgggcctgtaggacttggatcctgtgggaagccttggcagctttctttcccccctccttgcttaggcattagctctaagacagggatatttacaacacaattatttctttaaaattatatatatattttaatttgtacagatgaggtctccctgtgttgtccaggttggtttcaaacccctgagctcaagccatcttcttgcctcggcctccgaaagtgttgggattacaggtgtgagccattatacctggccttcaactcagtccctaaagacaactccttctcaagtgttggaaagaaccaatgactaatcacttctagtctgccttatccccatcttgcttgtgtgactttggtaagagtttgtttgtttatttaaaggagcagagagtttaataggcaagaaggggcaagaaagaagggagaataagatcccctgtatagagacggaggagggctccaaagctgagagagggaaccccagctgccacagatagcagctaggtatatgtacagaggctggaagaggcagtgtctgatttgcataggcctcaggggattggtttgactaggcatgtctttcacgtagcgcatgaaaaagctggccctcccacctagccttttaatatgcaaatgcagggtaccatgatctgcacacttggggaggtgtggtggcggccatgttgctaggaacatgtggggaaagggcaagaaggctgtgggaatcgccatgtttgggtggacccagtttctaatggcttgcatttgcatatcaaaggttgctggcctggctctaagagccggggctttacaagaaacttttccggagttgctttaaaaaccaaacatttcccaaggaccccttttcctctctatttgcctaaaataattgcttaactcctacattaccccctgtggagatgccacattaactgctgttagggggttttgggcgacgacttcttctggctacttcctggtgaaaaggggcgttgaatggggaacagcagctagggctcctcctggggtggatctaagggtcctcggaagaatggcgtgtccatgtgtgcttcaggttacagcaccattttgagtttgattgcttcagtctgatgaaataatttcctttcctggccaacacaccaaaatgatacggctccgatgagtgggggaacaccagggttcttggtcctcatgccggtttagataaaatgacacagacacacgtggagtggttttaaggagtggagagtttaataggcaagaaggaagggagaaggaagaaggtcccctgtacagagacagagggtggggggctccaaagctgagagacggaacctccaggagttgattttataaataaaataacatgcgttgaggtcactctgtgttgtgtggtatgcccagccctctctgcacataacttgtttcaggcccacagtcatgctgggtggttgctgtaatgactttttattttaaatggggaatctgtgacacagttaaacatgcgcaggatcatgtcactagcaaggagtggacacggtattcaaacccagcaggttgactcaaagcctgccctttccccagctgttttgcccctcagtcatttgagtctagtcttcaggattttgacatctatctcttaccttgtatctgttaggattgcatctggcttcaagaaacagccctacttcagcagcctaagcagaaaggtattcatttgtttattttttacatgtcaggaattccagtacctcttggagttgctggcattggattagtgatgcagggttgttaggactgacatctctgctgttttcttgtcttttcctcaaggcccctaaatggctgctacagccctaggcaatatatctgggttcaaggtaggaagagggagggattgcaccagcctcatgggttcctttctattcaggaaagtccaagccttcttcaaaggctcttctgtccacattgcagacttctggtcatgtctccttggctgaaactggattacatgaccacctctagctgcaagggaggcaggaaaaatgagcatttggttttatgcttctctaggaggaaacagcaagggagaaacttttgagtaagccagccaatattgtccaacatgtacttattttttaactttttttttttttttttttttttttgaggcaaggtctggctggctctgttgccgaggctagagtgtggtggcacaatctcagctcgctgcaacctctacctcctaggctgaagctatcctcccaccttagcctccagagtagctgggactaccacatgcaccaccatacctggctaatttttatatttgtagagatggggtctcaccatgttgcccaggctgctcttgaacttgtgagttcaagtcgtctgcccacctcagcctcccaaagtgctgggatgacaggcatgagccatcacactcagctaatgtttttctttcaatcaattcactttttaagccttaacaaagttatcgcaaaaggaagtttcatatcactttagaatgtctttgaagtcacaggttggttatatttatgtgcttactttaatagctattaaagtaaatatagcactactaagaaaaaaagatattctttaaatcgcctattatcagtggttcttaactctggatgattttgtctccaggggacatttggcaatgtctggaaacatttttggctgtcacgatggggcagggagcgcacgcctagagtctagtgggtagaggccagggggtgtgctaaatatcctacaatacaggatgggctccataatgaaaaatcctctggtcccaaatgtcagtagtactgcagttgagaaaccctggcatggacgcaatccacctgctgccaggagttatatacaagccatgttagggtaatgctgcaatatgtccatcgtgattgtgttttctcctgggtgactatcagcaatggtgtagcctgcttgttggttttcaaggtccattctcaagatactatcagatctccagcaatcgtgtgatgcagtttaaaatgttcatgtgagctgggcgtggtgactcatgcctataatcccagcactttgggaggccaaggctggagaatggcttgagcccaggagtttgaaaccagcctgggcaacatagcgagacccagtctctacacaaaattaaaaaaaaaaaaaaattagcccggtatgatggtgcatggccatggtcacagctactcaggaggcagaggtgggatgatcacctgggcctgggaggttgaggctgcggtgagccacgattgcaccaccgtattccagcttgggtgacagagtgagaccctgtctcaaaaaaaagaatgtgcatatgaattcaagatatgtcccttatagagactggtgaggacacagcttattgaccctgaagctgaagtggttgaaatgatagccctcttgccaggcaaatcctatgtgagtgcttctaaaagaacactgtaccttgcagagagtattcctgggacctggcaggaatcagggcctcttggtgaccacatgctttggaaagggctgtgctttggcaagtgggagattttattatttattttctcctgtctgcctcggtttggcaaaaacaaacctggcctgggcatgggccttgtggagacaagaaggcagcttgagattatcagagatcaggctgctggtgggtttgcctgagctggcctggtcaggtagcttgacaatgatgctcagacccccattaaagttaattgagcggttacagagtgggagtggggagtggggggtgtggtgactgcctgtctccttgagttggcgtggctaagaagtaagggaattttttaacttttccttcttaattctggaaacttagaaaaaagcctctcaccatcccttaatcattcagttagagagaccaggctgttgatatggacatgctgcgtttcatggaatcctagaggccagtatttatgacatacttcccagtttcagagatgttaggatataaaaatgtagccagcagtgtttacaggatgggctaatcgagagacacagacaaatatcaaagatagcaaaataggaagaaacagagtcttagaatcaatgcagtataataatagcttctagtttctttctgtttttctttttatgatacagagtctcactctgtcgcccaggctggactgcggtggcatgatctcggctcactgtagcctccgtctcctgggttcaagtgatcctcccatctcagcctccaagtcactgggattacaagttgtttgccaccatgcccagctaatttttgtatttttaatagagacagggtttcaccatgttggccaggttggtcttgaatgcctgacctcaagtgatcccccccagccttggcttcccaaagtactgggatgacaggtgtgagccaccatgcccagcctccccctcactcttaagcacagctcttcggcagtcagagatgttgcctgctgtatttctcgttctgcttttacacatggtttaaaaatcctcgcccaagaatgtaagccccatggctagtgctacctgctacctttaggggtggcctctcctggggtgcaggaggttgcacagttcgttttgtgacagcagggtcattttttaatcggatcatctgccccagtttgcttggctcttaggtgcttgggagttctcctggttttttgctgttgtgaaatggcccagcttgtacacgttgttccttttcttgctggagttatttcctttagactcctgtccctaaagtaggattgttgggtgaaaatggggtatgcgtggttaggcttttctctgcctgctttctggattgctcttcagatagatttaatcaccttttatttatgttttgtggtggttttttttgttttttttgtttttttttgttttgagactgagttttggtcttgttgcgcaggctggagtgcaatggtggggtctcggctcacagcaacctctgcctcctgggttcaaacgattctccttcctcagcttcctgagtagctgggattacaggcatgcgccaccatctctggctaattttgaatttttattacagacggggtttctccatgttggtaaagctggtctggaactcccaacctcaggtgatctgcccgcctcagcctcccaaggtgctgggattacaggcgtgagccgccacacctggccaccttttatttgttgaatgagtgtttaataagcatgtcctatatgcatcaggagaattaaatggacatggtcttgctttggggggaaatgacaggtaggagagaaagagacacttagaactcaacagaggccagacgcggtggcttacgcctgttatcccagcactttgggaggctgaggtgggcggatcacctgagatcaggagttcgagaccagcctggccaaaatggtgaaatcccgtctctactaaaatataaaatcaatcaggcgtggtgatggcacatgcctgtgatcccagctactcgggaggctgaggcaggagaattgcttgaacctgggaggcagacattgcagtgagccgagattgcactactgcactccagcctgggcagcaagagcaaaactctgtctcaaaaaagaaaaaactcaacagagaaaaggcggatcgttaaggcttctttggcacttcctaagtgccagggactgttgttaatgcctttgaagtgctaataatgacttaatggtgacaagttccctgtgaagcagggactgtgattgtttctaccttatgggtggggaaaggaggcagagagaggtgaagtcacccagctagtaaatgacaggactagactgaaacccaggcagtctgtctccagggcctggccggtaccccatgctccatcttgccccataaacaccctggggtgggccagagaggagtcttttccaacaggctgtgccagatgactttggctaatcttggaggctggaggattagtcagtctactaagggggcttcagcattttggcacgtggctttatgagctgtttactccaacagtgatgatgacaatagccatagtagtgataatactatggtagaagtaactgcagcaaactcaacccctaacgagtattctatcttcccaacattgtgtgcaatagccatgagagatgggtgttattcttttaatttgacacacgggaactgaaagccagagagattgggtggcttcccccaggccacacagcctggaagtagtaggacagggactcgagcccagatctgctgccccagagcctgtgcccttgaccaccaagtcatggtcactcctttcaaccctgcctgcccctgggccatctgtgttgtgatgccggctggccaggatggggagtgaggatttcagtttgtcatagggcagggagatgggtgaggcaggacactccttgagatggaaggctctggggtcgggggagagggagtggtggagactggggtgtctccgaaggagtgtttgaagatgacggtggtttttccagtttcctgttcttagctatattcaagaaaagggtaagccagaaaatttccctctgagtttcacaacttctgggagcttttgcaaagtctgggtgatgcagcattttcctggtttgaatcctaagtgaagtttcattttccttcacttaactcattctggctctggcctgtcttcccagctgtattggccatctggtcctcttctggctctttgtcccatttattattatttatttttatttttaacagagatggggtctcactgtgttgccgtctgttctggaactcctggacccaagtgatcctcctgcctcggtctcccaaaatactgggattataggcatgagcctctgtggccagcttataccccctaagcttgtgactatcttctatgtgtgtccctcttggagtgaggttccctcctgtctccatgttggcaaatcttagcaccttggcccttcgagatggaggtctgtgttgcctaggctggtcctgaactcctggtctcaagtgatcctcccatcttggccttccagagtgctgggattacaggtgtgagccactgtgtccagccaacccttcttagattttacttacttcaagaagcctgctttgacctctcaagtggaaataacaacttccaggaatagagtgatcactgggcatccatctgttgtcacatgaatgattttatccatattaaggaggcattacatgcagcagtgagctaacctgcctgtgttgaagttttcttctttttacaggctgtacaaccttgggcaagttgctttacttctctgtgccttagtctcttcctcagcaaaatggaaaaaatactacccatttcaaatggggtgaaaatgaaataatatataagtctcgtcttcacaatgtctctgatgaaaagcaggtattggttgcacatggtgctcatgcctgtaatcccagcactttgggaggccgagcagggaggattgcttgaggccaggagcttgagaccagcctggggaacatggccagaccacatctcttaaaaaaaatttagctaggtttggtggcatgcacttgtggttctaactagtttggagcaggtgaggagggaggatctcctgagctcaggaggttgaggctgcagtgagctgtgattgcacacgactgctttccagcctgggcaacagagtgaaaccccatctcaaacaaacaaacaaacaaacaaacaaataaacaaaaaacaggtattgtccttgctgtatgaatgaggaaagtgagttttcctttttgctttgtgaaactcttttctggatatttcttgccttttatgtgtatctctttggtggtactctgtgcttttaaaatcttttgtaatggccatttatggacaaatcgtatcttatattcaagattctaagctttctgagggcaggatataaatgtggttgtttctggttcaagtcctgatacaagcaaagctcagtaatttttttaaatgaatgggtgggccggtggttgggtcttcagagtcactaaatactggtggcaggagtgggaccacatagaaaaaaatattaaggcagtggatctcaatggggagtgatctgcctctcagaggacgttcattgatgtctagagacatttttgttgtcacagtttgggatgggggtgcagttggtgtctgttgggttaggatcaggaatgctataaacatcctgtgatacacgggacagacgtatccagcctaaaacgtcagtagtgttgagggtgagaaaccctgggcttattaaggcaacaagcaacatattaatagcaacaggagaaaacatgcatttaaattttttttggccaggcgtggtggctcacacccgtagtcccagcacttcggggggcccaggtgggcggatcatgaggtcaagacatcgagaccatcctggtgaacatggtgaaaccccatctctactaaaaatacaaaaattagttgggtgtggtggtgtgtgcctgtagtcccagctacttgggaggctgaggcaggaaaatcactttaacctgggaggcggaggttgcagtgagctgagattgcactactgcactccagcctggagacagagcaagactctgtctcaaacaaacaaacaaacaaacaaaaaaaaaacaaaattttttttccacaaatgtgaagtagtctagatgagatacgctcttcctgagatgataaagtgaggtctaagtgtatttattaattcttttgaggagggtgttaggtgctaaaggcagcacgtgtaaggtgaaaattgcgtatagccaaaatgaccctggggcttattctctctctctctctcttttttaataaacagcttttttgttgagatataattcacataccatatgatgcacctataaagtgtgcaactcagtttagtacattcagaattgtgcatgtctcctgtctccaggtaggcaaatcttagcacctcggcccttcttagattttattttttagagatgggggtctcactatgttgcccaggctggtcttgaacttcttggccttcctcccatcttggccttccagagtgactatattcaatattcaaagtgactgtagtcaacattagatatttttatcaccctgcttacttgtttttatttaagacctggtgtggtgtgtgcctggccttgtgatcacaaatgctagttacactgaattgacattttgctgagactcgttctgaggtccattcatagatgccctaggtacttcctgattacttgccacaccccaggaattctgcacagtgagtggggagtgacattttgagggacagcatcagtacattcactgcgctaaagaaacagtctggggagagtgagacatcgaaaaaataacatataaaataaacatctgatggagacataggaagatgccaaccttcaacaatgtttgacttggagcaggggttggcatgctttttctgtgaagggttaggtagtacatattttaggtctctcaggcccaggggcaaatagtctttcttataatatgtatttaaaaattggccaggcatggtggcttctgcctgtaatctcagcactttgagaggccaaggtgggaagattgcttgagcccaggagttcgagaccagcctcagcaacaaagtgagactctgtttgtattagtctgttctcacgctgctataaagaactgcccaacactaggtagtttataagggaaagaggtttaattgactcacaattccacagggctggggagacctcaggaaacttatactcacagcagaaagggaagcaaacatgtcctccttcacatggtggcaggaaggagaagtgctgagcaaaaggggaaaagccgtttatcaaaccatcagatcttgtgagaactcactataatgagaacagcatggaggtaactgcccccatgattgaattgtctctcactgggttcctcccacaacacatggggattatgagaactacaattcaagataagatttgggtggggatacagctgaaccatataattccatggccaaatgatatcgttctgcccctcccaaatctcatgtcctcacatttcaaaacacaatcatgcctttccaagtgtcacccagagtcttagctcattccagcattaacccaaaagtccaattccaaagtctcatctgagacaaggcaagtcccttctgcctattagcctgtaaaactgaaagcaagttagttacttcctagatacaataggagtacaagcattgggtaaatacacccattccaaatgggaaaatttggccaaaatgaaggggctgcaggccccatgcaagtctgaaatccagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgttgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggttctccatgagggctccactgctgcagcaaacttctgcctggacacccaggcatttccatgcatcctctgaaatctaggtggaggttcccaaaccttgattcttgacttttgtccacaggctcaataccacatggaatctcctaaggcttttgaggcttgcaccctctgatggcacagcccgagcagcattttggccccttttagccacagttgaagcaactggaacaaagtgtaccaactccctaggcagcacacagcaggggggccctgggcccggcctatggaatcattttttcctcctagacctctaggcctgtgatgggaggggctactgcaaaggtctctgacatgccctggagacattttccccattgtcttggtgattaacatttggttccgttttacttatgcaaatttctgcagcaggcttgaatttttccccagaaaatgggtttttcttttccgtcacatcatcacccttccaatgtttcaaacttttatgctctgcttcctcttaaacactttgttgcttagaaatttcttctgacaatcatctaaatcatctctctcaagttctaagttccacagctctttagggcaaaggcaaaatgctgccactctttttgcttaagcatagcaagagtcaccttggctccatttcccaagaagttcctcatctccatctgagaccacctcagcctggacttcattgtccatatcactatcagcgttttggtccaagtcattcaataagtccctaggaagttccaaactttcttacatcttgctatactcttctgagccctccaaactgttccagcctctgcctgatactcagttccaaagttgcttccacatttttgggtatctttacagtagcaccccactcccagtaccaatttactgtattagtttgttctcacgctgctataaagaactgcccaagactgggtagtttataaagggaagagatttagttggcccacagttctgcagggctggggaggcctcaggaagcttgtaatcatggtagaaggggaagcaaacacgtccttcttcacatggcggcaggaaggagaagtgctgagcaaaagtgcttcttttgctgagaagtgttgagcaaaatcagatcttgtgagaattcactgtcacaagaacagcatggaggtaaccacccccatgattcagttacctcccactgggtttcttccatgacatgtgaggattatgggaactgcagttcaaaatgagatttgggtggggacacagccaagccatatcactgtctctaccaaaaaaaaaaaaaaagccaggtgtggtggctcatgcctgtatcccagctactcatgaggctgagatgggaggattgcttaagtccaggaggttgagactgcagtcagctatgaccacaccactgcactccagtctgggcaacagagtgagacgctgtcaaaaaaaaaaaaaaaaaaaaaggaaatccattcttagcctgtgtgctgtacaaaagcaggcagcaggctgaatttggcccacaggctgtggttcgccaacttatgacctatacaaatggcaattcatatggttcatcctagcgataactgtacatggtgtattagatactatatagcatgttcatatcaaatgtcatataatgtataaggtaacatatacagtataaaatagtgcctgagaaatatttgatgaaaaaatctgataagtacttagcaggcacagtacaaagtaccatgaagttgttaaatgggggatcagggtgtttgagaaaggggtggggagataggtgggcctccctcaagaaggaatgtttcaactgtgagctgaaggatgcccctgcattgcatgtcagggcagtgatggggagaaagactccaggtagagggaacccactctgcaaaggccctgagtcatgaaggggtccctggaacagtgagttggggctgaacccacaagctgcagttgtggggattgtgatccatcctgagagctctgagaacctggaatagttttcagcgcagtgtgaagggactggggctgtgttttgaagatatcccctgtctgcggttgggaggggagtcaggaaacctatttggaggctggggttttcacccaggtcatgcagataagatttattaggtgtggaatgaactgagcaaatcacatgtcttctaatggtacaccacactttttttttttttttttggttttgagacagtcttgctctgtctcccaggctggagagcaatggcatgatcacggctcactgtagccttgacttcccaggttcaagcaatcctcctacctcagcttccggagtagctgggactacaggtgcccactaccatgcctggctaattttggtatttttattggagacggggtttcatcatgttggccaggctcctctctaacttctgacctcaagtgattcgcctgcctcagcctcccaaagtactgggattacaggtacaagccaccgcgcctggcctttagtgatattttaaagactaaattcccttagagatgcctgggtctgcatttattgctactgttctgtttctcactgtgtgtcttgaggtcatcaaaagtaacctgggccttttcccttgttttctgcctcctctaggcttatgagccattaagcaaagccggattggtgtgtgggtcaggctcttcatgttttctttagcttaataagcagtttctaagggaactcattgtgtcattgtttagaatagcaaaagatgagcagcctcccaagtggcaatcagtaggggctgggtgaatacagtgggttccaccccttccgtggtagggtgggatgcttgcagaaggacataagacgaggaagccctttgtgcacagatgtgcggcagcctccaaggtccagtttttaagtgaaaacgtggagatccacttggtatatttggtatgttacctctgtgtaaaaaagcagacaagtaagaattacgtagttgtatttgctgtatttgtaagaaattccagagggataaatgagaaactaaaagaggcaattgcatttgggcagagtaactttttattgtttaccttgatatatactttttttttttttgagatagagtctcgccctgtcaacaggctggagtgcagtggcgtgatcgtggctcactgcatcctccgcttcccagtttcaagcgattctcctgcctcagccttctgagtagctgagattacaggtgtgtgcgccaccaagctcagctaatttttggtatctttagtagagattgggtttcaccacgttggctgggctggtctcgaacccctgacctcgtgatctgcccaccttggcctcccaaagtgctgagattacaggcttgagccaccgcgcccggcctatatatgtattatataaacatatgcacacgcatgcatacgtacacacatatatattttttaaaaattgagtcatggccaggtgcagtgtgggtcacacctgtaatcccagcactttggcaggtgaaggtgggaggattgcctgagctcaggagtttgagaccagcctgggcaacatggagaaaccccttctctacaaaaatcacaaaaattggctgggcgtggtggcatacacctgtggtcccagctgcctggaaggctgaggtgggaggattgcttgagcctggtaggtagaggccgcagtgagccatgatcacgccactgcactccagcctgggtgagagagtgagactctgtcttaaagcaaaaacagagtcatatatttcctattaaggtgaaatttaaaaaataaattcctatattccatcatccccagcttctgccattctaaagcattttcctaagcagctccactgtggatgtagcgggtatttcagaaaggcattagaaatgccctgggagggcagaacccggggcttcactggaggtgctgttgggctcagtctgatgtcaaggcagggacatggcaagggtattgagatgtgaacaagcattactcagcaaggtgacatgtgttcatgccttgatacacttgtttccccaccagctctatttttgttgcctgctctattggtttctttttcttttttttttcttttgagactgagttttgcttttgttgcccaggctggagtgcaatggcaccatctcggctcactgcatcttccgcctcctgggttcaagtgattctcctgccccagcctcctgagtagctgggactacaggtgtgcaccaccatgcccagctaatttttatatttttagtagagacggggtttcttcatgttggtcgggctggtctcgaactcctgacctcaggtgatcctcctgctttgggctcccaaagtgctgggattacaggtgtgagccactgtgcccagtctctattggtttcttattgctggtattgccatcaacttggtgactgagaacaacacacatcactctagttctcgggagtcagaggtccaaaatgtacggctggtgttctttccggaagcttgcagggagaatccatggcctggccctgtccagcatcaagaggccacctgtcttcctcaattcgtggtttcatgtccctccacccctgcttgtgttgtcaaatctcctttactttttttttatttttgagacggaatctcagctcactgtagtctctgcctcccaggttcaagtgattctcctgcctcagcttcctgagtagctgggattacaggtgcatgtcaccatgcctggctaatttttgtatttttagtagagacggggtttcaccatgttggacaggctggtcttgaactcctgaccccgggtgatctacctgcctcagcctcccaaagtggtgggattataggcatgagccaccacgccctgcctcaaatctccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccaccccccgccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatctttgttgaatgacacaatcaatcatttggttaggctagagaatgtggaaggaggccgggtgcagtggctcacgcctgtaatcctaaggctgaggcaggtggatcacttgagctcaggagtttgagaccagcctggacaatgtggcgaaaccccatctctcctaaaaatagaaaaattacctgggtgtgatagtgtgtgtctgtagtcccagctactcaggaggctgaggcgggaggatcacttgagcccagaaggtggaggtttcagtgagctgagatcatggcactgcagtccagtctgggcaacaaaacgagaccctgtgtcagaaaaagagagaatgtggagggatattatagcaagaagtggatctggaagttttactagtagtggtatttattgagcacctactgtgtgctctggctcatgtttaacaaagtgcttatttgcataatgttagtattcccattttacagatgcggaaactgaggtttagttgctggcctagtattacagggtgaggagctgaagccccatctgcctgacgaggggtgtgttggggatgtggactagaagcttggtcagggagggattctgttcaaacagggctgcttagctttggcactgttgacatttggggccagatatttcccgtcgtgggggctgtcctatgtattgtggccattaagcagtatccctggcctctgtccacagagtgccaatagcactaccctcttcctaagttgtgaaaacccaggatgtttccaaatgttgtcacatgtcccctgagtgacaaacttgcccccacttgagaaccatggtgttgaaacatagatcacggcacatcaactccatgctcctcaggtcaccctgcgtgaaagtcagaatccctgcggtggcctgtgcgtcccgcactgactgtctcctccctgccttcttccttcctcgctgtcttcactgcttgttattcttcagacctgttggcctctctgcggtttctcagaaatgccaggcctggtctgacttcaggacctttgcactggctgttttctctgcttggtgtgcccttcctccagatggccatttggtttactcctctgtttccttccatcctgtatttgtttatttatttttaattgagatggagtctcgctctgtcacccaggctggagtgcagtggtgtgatcgcagatcactgcaacctccaccacccaggttcaagggattctcgtgcctcagcctcctgagtagctgggattacaggcatgcactaccacgctatgttggccaggctggtcttgaactcctggcctcaagtgacccacttgtcttggcctcccaaagtgctgggattataggtgtgagccactgtgcctggctcaatcctgtatttaaatacccgtcctcagcaaggcttgccctcttctctgagtgcttttcatcacacatgtcttcatatcctctcctttctaaaccatctgtctcttctctttaggctgtcagctccaggagggccggcccttggtccctattgttcactgctgggccctcagccctaggaaccgtgctctgtaaatggatgaatgctgtctgtcctgttactgcagtgtccccagacatatccctatgcccagcacatgcctgacccctcacaagaccctggaacatgactaagggatttatttggtgaaacatgagagtctgataagaggagaggaagtggctggggagcaaccttgcaaagatagccagggttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaaaaaaaaaaaaaaaaattagttttgcatgtaactgtgttcagttctgtgtcttggacgtgaggatttgtggtacccgcctggatagagcaaggatggccgtgcccctgccttcctgggtgatggggataagtctggaaattgcccctgtgatgttactgggctttattcttagctctgctgagttagggggcagggtggggtgcagcccagccaacagcatgccagggcgcgtcactgcccacgcgatgctggcttcagccgccttcctctcacctcatggccctgccagccgtgcttgcctcctgctgtgtcggggctgggagactttagcctttctccagatgttttcaggagtgcggtggggaaatgaaggccacatgctgtctctctaaacaggattaatgttcagaagcccagcgggtgccctgacctaaccacgggcctcttgcactccttttctcagcttcccttggcttctgagctacccctctgcagcgttgtttctgagtgtggcatttaggagcaccctgtcgtcttgcctttcgtccctccaagccccgtctgttccttggttggttgtgcagaagagttgctagggtttgaatccaggacggtcctgcccctgtgactcgcgggccatcttctcacctgtttgtctctgtgttcctctctgtaaaagtgggaatcattacagtaccttcctcatagactgctagggtgataaaatggagcgatgtacatgaaacctgaacgcagtgcctggtatgcagtccgtgcttagacagggctctggttttatttttatttctttttctttgagacttggtctcactctgtcacccaggctggagttcattagcataatcacgtctcactgcagcttcccactcctgggctcaagcgatcttaccacctcagcctcccaagtaggtgggattacaggtgtgagccactgtgcctggcaccattcagcaatttttttttgttttgtttttgagacagagcctggctctgtcacccaggctggagtacagtggtgcgatctcagctcactgcagtctctgtctttcaggttcaagtgattctcctgcctcagcctcccaagcagctgggattacaggcgtctgccaccacacccagctaatttttagtagagacagggtttcaccatagtggccaggctggtcttgaactcctgacttcaagtgatccaccctcctcggcctcccaaagtgctgggattacaggcatgagccatcacacccggccatcagcaaatttttaagtatacaatatagtattgtgagctatagacactattctgtacagtagaccgtaggactgactgactcatcttgtatgaccaaaactttatacgctttgaccaacacctccctgtttcccccaccaccagctccttgcaactaccattctgttctctgcttctatgagtttgtcttttttagatgtcacatgtgagtgagatcttgcagtgttcgtcttcctgtgcctggcttatttcatttagcataatgttctccaggcgcatccatgttgttgcaaatggcaggatttctttccttttttttttagacagagtcttgctctgtctcccaggctggagtgcagtggcacgatctcggctcactgcaagctccgcctcctgggttcacgccatcctcctgcctcagcctcccgagtagctggaaccacaggtgcctgccgccacgcccggctaattttttttttttttttttttgcatttttagtagagatggggtttcaccgtgttagccaggttggtctcgacctcctgaccttgtgatccgcctgccttgacctcccaaagcggtgggattacaggtgtgagcgactgcgcccggccaggatttctttcctttttaaggctgagcgatagtccatggcatgtatagatcatgttttctttgtccacttgaccacggatagacatttagttgtctccatcttggttgctgtgagtgacgctccagtgaacacgggagtgcagatatctcttcagggcccatgtgtggctgagattaggagatcactgctgtcgtctctagttcagcagtgctagtgcctcctggcgtttagcgtccagctcaagggagtggaatttgggtgtctcagggtctagggccacctgtgcctctaaatcgcagggaagctttgtgtgtgtgtgtggtggggtgcggggggctatgggtatgtggtggggtgaatcttatttctcttctttcccttttcttaattttccgttggcaaaacagagcgccactccagacccctttcattcttgcaatatacatgaaaagtacagggcttgttctgcaaaagaagagtagccccagcgagctcagggttgagtgaagttccgcaaggatggcacctctcggctcttctgggggcttcaggacagagctcagtgtcgccaagcaggacccccactgcgggcggagctgcagggccatcaacattcattaggtggatcagtgaatgtagactctgcggtgtcacaaagcagcacctgtactcactgtgcctgtctcgggatggaatctaagtcagacatccttgcatccccacttatgggctgttccttcaccttgctggtcctcacctttctcctagagttacggggaggagtaaatgtgctaaggccatacacgccgactctgcagtggccttgaaccatgcttctctgtcacccctttcgttgccttgacaatggctgcagcctcctttcccatctcccctaggatcttctcctagggtctcttaatacaggggtccccaatccccagagcacggactggcaccagttcatgcatgccctgttaggaaccaggccacaggccacacagcaggaggtgagtggcaggcgagcgtgtgagacttcatctgtatttacagccgctccccatcttttgcatcaccgcctgagctctgcctcctgtcagatcacctgtggcattagattctcataggagcgcgaaccctgctgtgaaccgtgtgcgcgagggatccaggctgtgtgcttcttttgagaatgcaatgcctgatgatctatcactgtctcccatcacagctgagatgggaccatctagttgcaggaaaacaaactcagggctcccaccgattctacataatggtgagttgtataattatttcattatatatgacaatgtaatcatagaaataaagtgcacaataaatgtaatgcactcgaatcatcccctaccctgtctgtgaaaaatcgtcttccacaaaacctatccttgctgccaaaaaggggatggctgtctttttttcttttgagatggattcttgctctgttgcccaggctggagtgcagtggcacaatctcggctcactgcagcctctgcctcccaggttccagcgattctcctgcctcagcctcctgggtagctgggattataggcacaatggcaccgtgcctggctaatttttgtatttttagtagagacggggttttaccatgttggccaggctgctctcaaactcctaaccttgggtgatcctcccgcctcggcctcccaaagtgctgggattacaggcgtgagccactgtgcctggccagggaccactgtcttaatatgtgaattaggcgatgccatgaccctgcttaatgcactcccagggcctcctgtgagaattagaacaaaaaatccatgctctgtaccatgcctccaagattggctatgtggtggcctttggtgacttctcccgcccaatcttgggtcctagctcattggtgcagccatatcctccccccaccccaccccactgtggcctttgcctgtgccatctttctgcctggtatgtgcttcccgagatctttgcacagccagctcttcctgacccttccagtctgctaggatgtcatctgcccagaccgccactctggtgcttcctgtcctgacacccctgctctttccttcacagcaggtactgctctttgtcattatgttcttatctgtgagctttcatctttgatggactatgagtcttaagaggacagagatatcgtttctgattttcccccatgcctgtgactagcccaggtctaggcatatagtaggtgctcaataaacagtcatcgaatgatagattgaatgaatgaatgcatgacaggaaccctgcacttatctgtgttaatccgtctcttggctgccgggaacaccagctcctgcaacctggcacttgggtcacctgattgaaccctcctgataactctctaaactctgtaataggtgggttctagaattagtcccatttcacagatgaagaaatcaaggcctggtgaggtgaactgacttgctttagggcagcagggatgatttttgcctctctggagatatttggcaatgtctagagacagttttgattgtcataacttgaggaggtggggagtgctactatcatctagtggcagaggccagcgacgccactcagtatcttacaatgcacaggatggcccccgacaaccaagaattatttgggctcaaataccagcggttctgaggttgaagaagccctgcttgagggcacacatctgtaagtggtggagacgggaacctagacctggaaccttgttttgttaaccactaccctgcactgctcacatgcgggggtgggtgggtgggaagagttgtagaatgtttccatgtctgagtcaaaatcttgcttctctgctctagggagatgaatttggaatctgtgaggcctgaggccattcacttgatctccggccctggagatcttgcctccaagcgacctcaggctccatctgtctgccatgtaccttgcaaacaccttagaattctggctgggcatggtggctcacacctctaatcccggcactctgggaggccgaggcgggcagactgagttcaagaccagcctgggcaacatggtaaaaccctgaatctacaaaagatacaaaaattagccaggcatggtgatgcgtgccaggtagtcccagctacttgggaggctgaggcaggaggattgctggagcccaggagatcgaggctgcagtgagctgtgatggtgccagtgtactcaagcctgggcaacagagtgagaccctgtctcaaaaaacaaaaccagctgaccaaacaaaccaaaaggccttagagttcaagcacgtggtttagaggtggtggatctcagtgtcagactctcagtgggttcaaatcctggccctgtttcttctaggttgacgagcccaagcaatttacataaactctctggacctcagagcccttgccaggaaaggggagagttttaatagtcctgactttgtagggctgttggaaagcttaaatggactgtgcttgggaagcacttaatcactgtgcctggcgtgatcactctggctgttattattggcacccaataaatacatgctttctctttgtttccaactcagcatttagaaatgtcctacccttcaattcctgctgctatttatttatttgaagtgcgaactagctttcttattattattttagaaatcatgcagaggagaaaattcaaacagtacgaaagataatacaacaaaaaatagtagttgccttcctctccctggtttcaggcctaccccctgcagattaattagctttttttctttctttttttcttttcttttttttgcaatatgaagtcttgctctgttgcccaggctggagtgcagtggtgtgattttgactcactgcaacctccgcctcctgggttcaagcaattctcctgcctcagcctccctagtagctgggattagggcagatcatgaggtcagaaatgtgacaacagcctggccaacatggtgaaactccatctgtactaaaaatgcaaaaattagccaggcgtggtagcaggcgtctgtaatcccaggtacttgcgaggctgaggcaggagaattgcttgaactcgggaggtggaggttgcagtgagccgagaccacaccattgcactccagcctgggcaacaagagcgaaactccgtctcaaaaaacaaacgaaacatcaaattcctgactgtgtatgctgcttgcaggttatatatgaccaggcctggttctgtatctgtaaaatgggttacgttatagtacctgagtcctagagttgtgtgtgaggatgaaatgtaatgtgaaacacttagagtggtgcttggctgatgcaactaatgaatcttccctcttactctttctatagacagaagaaggcggcacaggtttcttcattgcttttcgccctttgctgaaatgtcatcttggcccagaggccctttctgtctacctgataaagaactagcacctgcccacccaccattatgcttcacccactttcttcttcttcaagccatttgctcccattgggcatacatagagttgttttttttagctgttggtagttttggccgctttgcataaagtgaaattgtgtgagagtggagactttattttacttccacatgaccttggcccatggtagtagtcgctgataaatgtccactgagcaataagaacccgactgttgcaagttacttatttatttatttttgagacagggtctcagtctttcacctaggctggagttcggtggtgcagtcatagctcactgcagcctcgaactcctgggctcaagggatcctccttcgtcagcctctggagtagctgggactaaaggcaaacgtcatcacatctggctacttttaaatttttttatttgtagaaggtggggagtctcactccattgccacctctggtctcgaactcctgggctcaagtgatcctcctgcctcggtcccccaaagtgttgggattacaggtgtgtaccaccacgcccagctaagtttttttttttttttttttttttttgagatgcagtctcactcttttgtccaggctggagtgcagtggcctgatctcggctcaccacaacctccacctcctgggttcaagcgattctcctgtctcagtctcctgagtagctgggactacaggcgcacgccaccatgcccggctaatttttgtacatttagtagagagagggtttcactatgttggccaggctggtctcgaactcctgacctcatgatccgcccgcctcagcctcccaaagtgctgggattacaggcgtgaacccctccacccggccagctaagtttttaaatttttttgtagagatacagtctcactgtgttgcccaagctgatctgaaattcctggcctcaaactatcctcctgcctctgcctcttcaagtgctgggaaatataggcatgagccactgcacccagctggttgtgagttattgagatggttgaattgggagtggatgctcaggcctcagtggaacttgtggtacacagtatgtcctcattacctcccatcagtggcagttgagattcataatcactttttctgcctgttgtctgccccatcctctctgtggccttccctcctgtcctggagttggctggctgggtccctggcagggctgcatgcgttatccctgcaggcctgcttgccttatccctgcaggccctggtggagcatctgtgcagaacctgtgccatccagatgggagcagtaagggtgtagggcaaagttagtgagctgcccggtgcacgaggacttccatgataatcagggctgaaccaggaaggcaggtcaaggccagggtcatgtacagaaaggaggtcagcaccaggatcttgtatgggaagacttagatcaatgcctagtgccttagtcatcatcattcagcccagaaaacatgacgctatgcaacaggaattttatgaacacacaaaggtcaggggccactcggacttggacggggtccccaactctttgagtgtcagggctgagggcatggagacacaacttgatcaagctggtgaagtgtccagcaaggagaagcctctgttggagggagccgggagctggggaggacatgcgctttctcttttttttttttttttgagacggagtctcgctctatcgcccaggctggagtgcagtggtgcaatctcggctcactgcaacctctgcctcctgggttcaagcgattctcctgtctcagcctctcacgtagccgggactcaggcctgtgccaccacgcctggtgaatttttttgtatttttagtagagacggggtttcaccatgttagccaggatggtcttgatctcctgacctcgtgatccacctgccttggcctctgaaagtgctaggattataggcgtgagccaccgcgcccagccgacttgcgctttctctgtaaagatttctgtgggccaggttccccaaagggcaggccctgggccagtgcagtgaccggtgaccgtgttcaggactcatctcttgtggctgaattgtgtgtctggagagttgggtccttctgattctgctcagagcgtggtgggcctggctggatttccctagattaggaagcagcctcgggtagctgtgattctttgagttgggaacagcaagtggcctgcagactgccagggaatcgtcccttccttgagcctttaggtattgcccattattcaccgtttttcccagaagcctccagtagtgagagtcgcacttcttacctcctggagttgttaaagtaaagaaggacacattagggtccctgccggtaaggaacatccaggaggcctcgataccttttttttttttttttttttttccctgagacagagtctcgctctgtcacccaggctggaggacaatgacctgatctctgctcactgcaacctccacctcctgggtttaagcgattcttgtgcctcagctgcccgactagctgggattacaggcatttgccaccatggctggctaatgtattttttttttctttttcagtagagatggggtttcactatgttggccaggctggtcttgaactcctggcctcaagtgatctgccctcctcagcctcccaaagtgctgggatttcaggtgtgacccactgcgcccagtcccgatactttgtttctttgagacagtctcttactctgtcacccaggctggagtgcctgggtgggacgatcaaagctcactgcagcctcaagcccctaggctcaaaagatcctcccacttcagccttctgagtaggtgggactacaggcctgcactaccacgcctggataatttttaaatttttttggtgaagacagggtcttactttgttgcccaggcttttcttgaactcctgagctcaagcaatcctcccgcctcagcctcccaaagtgctgggtttacaggcgtgagccactgtgcccggtcctcagatgatcttagctttgtgacctatgctgttggccgctgtaggggctgtgatggaggtgatgtgggggtggatggcaggggtgacccgtgttggctgctttctgtaacagtcatagttcatggtcagagtcagatttcctctcgtcatgccttccttcccttccttctgctccctcccacagccgccctttgggtctgggctggccatctggctctgagcaggaagctagcctgtgctcttcaatttgctttctgcaggggaaacaccttcctttgctcagcgtttcctgacctctccttccctggagttccggtgtccttaaatgctctctggtttcttctgtagcttactttcttgcttgaaaggacaacttttctttgtcctttagacttcttatctctgggcaatacagtggtggtggcagtggtgattattatcaactattagtatctgctactacggtttattgtctctagactgtatcagcacctgtcacacattgtcccattgaatcctctccagaactcttccaaatgatgtgttttcctgacttttaaaaaaattaaaaaaaaatttttatatttttttgagacggagtctcgctctgtctcccaggctggagtgcagtgctgcgatctcggctcactgcaagctctgccttctgggttcatgccattctcctgcctcaacctcctgagtagctgggactacaggtgcccgccaccacacctggctaatttgttttttaatatttttagtagagacagggtttcaccgtgttagccaggatggtctccatctcctaacctcatgattctcccaccttggcctcccgaagtgctgggtttacaggcgtgagccactgtgcccagccaaaaaaatttttttaaagaaatggggtctcgctgggtgcgatggctcacgcctgtagtcccagcactttgggaggctgaggtgggcggatcacctgaggttgggagttccaggacagcctgaccaacatggagaaaccccatctctactaaaaatacgagattagccaggcgtggtggcaggcgcctatagtcccagctactcgggaagctgaggcaggagactcgtttgaacccgggaggcagagattgcggtgagctgaaatctctccattgcactccagcctgggcaacaagagtgaaactccgtctcaaaagaaaaaaaaaatagaaaaagaaaaataaaagaaatggggtctcactgtgttgcccaggctggtctagaattcctgggctccagctgtcctcccatttcggtctcccaaattgctgggattaaatgtgtgagcctctgtgcccggcctctttctctctctctctctctctctctctctctctctctctctcctctctctctctctctctctctctgtctctttctttctttctttctttctttctttctttctttcagcctgagtctcgctttgtcgccaggctggagtgcagtggcacgatctgggctcactgcaacctctgcttcccaggttcaagtgattcttctgcctcagcctcccgagtagctgggactacaggtgcatgccaccatgcctggctaatttttgtatttttagtacagacggagtttcaccatattagccaggatggtcttgaactcctgatctcatgatctgcccgcctcggtctcccaaagtgttgggattacaggcgtgagccaccgctcctggccttccttttttttgaagcaggttctcactctgttgcccaggttggagtgcaatggtgtgattatgtctcactgcagtgtctaccttccaaggctcaggtgatctcctgcttcagcccactgagtagctgggattataggcgagttcaccatgcctggctaatttttgtgtttctagtagagacgggtttcaccatgttgtccaggctggttttgaactcctgggctcaagtgatccacccgtgtcggcctcccaaagtgccgggattacaggcatgagccaccgtgtccagcttttctgactctttttacttatcaggagactgaagcttggagaaattaagtgacttgcccaagttcacatggggttaaggcctgaatttgaatctacatctgctcaattaggaagtgagtggtcatagctagtctctacctggatggattgttgtttaattgttaaattttttcaaaataattttaaattattttattaaaaaagagggtatcattatgtttcccaggctggtcttgaactcctgggctcaagtgatcctcctgccttggcctcccaaaatgctgaggttacaagtgcaaactactgtgcctagccagattattacttaacaaccaaaacaaaggaggaaattgacggtggacaagtaagaagatcattgcaaaggttgggggcaggttgtttggggagtgtggaggaagctttttaaatgaggtacctgagttggattttgaaggatgaataggagtttgttaggacagaaagacattgcagagagaggatctagcaagaggtgactgaagaaaccatttatttgaccagcagttggggaatgccttgaaggcaggaaccacagcctttcagaatctccagtgcctgcaacagtgtctagaacattatctgacaacaagcttggtaaatacttctttaagtaaatgcctgagtaaggcacatttggggaacagggtgggagaaattgtaggagaagtagatgggacttgaatgtagaaggaaggcctcatggatcactgcaagggttggttatttttttttattttttatgttttgagatggagtctcgctttgtcgcccaggctggagtgcagtggcgcgatctcggctcactgcaagctctgcctcccgggtgcacgccattctcctgcctcagcctctccaagtagctgggactacaggcgcccgccaccacgcccggctaattttttgtatttttagtagagacggggtttcactgtggtctcgatctgctgacctcgtgatccacccacctcggcctcccaaagtgctgggattacaagcgtgagccaccgcgcccagccagggttggttcttaaaagccaatagggagccatgggaagttgtttcccagcagaagagagaaggccattagatctgccctatttattaatgcaaatatctaagtctatgaatcttcctctgagcaggaaaacgtgattgcttttaaatccatatggaaagaccctcagttttactcatgataaagagaaaaggaacttaaactacacagagatatttttcacttcagattggcagaggtcggaaacttgttatctgctgtgctttgtgaagtaattgcctttgtaccttatcagctggagtatgaattgatgttccctatttggagggcagtgtctgtctaaatgttactgtaggcaccctttgacctggcaggttccttttttgaaagtttatatatatgtgagacagagtctcattatgttgcccagggtggtttcaaactcctgggctcatgggatcctcccacctgggcctcccaaaatgctggagttacagatgggagccaccacacctggcagagaaagtgatcttatcaacactcttgcttgagtgtgaaattcaattgtttattcaatgctgcattgtttgtaagaggaacaccaatgccaagtccccaggagaccgatggaagtcaagttcatccctacaatagaatacaaagcagccgtaacaaagagtgaggaaactgttcatgtatactgcgggatgatctttaaaatctgtggttaagagaaaaaagcaaagtacggaacattatgtaacgtatgcttccttcgatttgataacagaagatgtatatttactttatttttgtataaaatattttctgaaagaagacataagcaacccatgatcattgcctctagagagaggaactgaggggagggccatagggaatggaatgagaagacttgtcccttgtacctctttgttcaaaagaaatatcaagaataaaacacatctatgttactgataaagatagtttccaaaggctgtgtgcggtggttcacacctgtgatcccagcactttgggtggccaaggcgagtggatcgcttgagctcaggactttgagaccagcctgagcaacatggcaaaaccccatttctactaaaaatacaaaattagctgggcatggtggtgtgtgcctgtggtcctagctgctcaggaggctgaggtgggaggattgctggagcctgagaggttgaggctgcagtgagctatgattgcaccactgcattccagcctgggcaacagagtgagaccttgtctcaaaaaaaaaaaaaaaagttcagtttttaatattagctaagtaaaaaaaagcaaggtatagaatggagtatcgtagtgccttttgtggcaacaaaataggtcgtatttggaatatatctggaagaatgtaagatgttagcaatggtagcttgcctgtagggtagcaatggggggctgttaatttggggagaaagacatatttttcactgtatacctttttgagtaatttgaaagagttttagcacacaaatatattacctattaaaaataattacaaagagagggagacatgggtggatgcatggatggatagttggttgggtagatggatacatagacaggtggatggattggttggtggatggatggatgaactgttgggtgggtagatggattgatgggtgaatgaattggtaggtgggtagggtggatggatgaattggtggatgggtaggtggatggatgaatgaactggtgggttgctggatgggtggatgaattggtaggtgggtggatggatggattgatgggtgaatgaattggtaggtgggtagggtggatggatgaattggtggatgggtaggtggatggatgaatgaactggtgggttgctggatgggtggatgaattggtaggtgggtggatggatggatggatgggtgaatgaattggtaggtgggtagggtggatgggtgaattagtggatgggtaggtgcatggatgaatgaattggtgggttggtggatgggtggatgaattggtaggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatgggtgaatgaattggtaggtgggtagggtggatgggtgaattggtgaatgggtaggtggatggatgaatgaattggtgggtgggtggatgggtggatgaattggtaggtgggtagctgaatggatgaattggttggggggggtggatggatgaattggtgagtgggtagttgggtggatggatgcattggtgggtgggtggatggatgaattggtggatggatggatggatgggttcatggttgggtgataaatatatccatgggtatacatatggatgtgtacatagataattctctggctatgatagggaggactggctgtggtggggaacactgactgtggtggggagcactggctgtagcggggaggactcagtaggacaaggagaggctggaggcagtgaagacttaggaagcagttgcatagtcctggcaaggaataatttggggctaggatcaggtcaattaaatgtttaacattggaactatgtctcttgtatacataactgcatatgtcaagtcttggtatcgttttctttctagcagggcacattcctttggaatgagcttttactggcaactgctcagaagctgttctgtatataatgaccaccaacagtttaatccttttttcagccatcacctcaggaattaacagtagtatgaaatcaattaaaataatcagtctttgagatgtcatgccttctccacgatcaacttcttctttacaaggctgtgttccaaatacgccaggccaaaaagacgtgaactttgtcctttttagggtttgtgtcttgatgtttcctggctaaatctctttgtatgtgttggccttgtaaggtttactttttttttttttttttttgagatggagactgtgttgcccaggctggagtgcagtggtgcagtctcagctcactgcaacctttgcctcccgggttcaggtgattctcctgcctgagcctccctactagctgggattacagacgtgcactaccctgcccggctaatttttatgtttttagtaaaatataaaaattatgtttttatggggggttcttgccatgttggccgggcttgtctcagactcctgactgcctgcctaggcctcccaaagtgctgggattacaggcatgagccaccgcgcccaacctaataactagatctctttaattattggaacatgtatattttgatcagattgacacttttttttttaagtgaagtgatcttatttccctcatttctcatttttaacttttttttttttttgatatggctttaaagctctgtggagctgtaagggtctgggttccttgacactccatgggggtctcaggtgatcgtgggagggctgttggaatcagagctatttggagggtgcataggccagtaggatgggaaggctgtgggagaagtgggctttttggggaccgcagccaaatggacaactgggcctaatctaaagattggcccctcccagctcctactgatggtcatgtaacaggaatggggcccagcaccaccagattttctgatttttttttttttttttgagacacagtcttgctctgttgccaggctggagtgcagtggcatgatattggctcactgcaacctccgcctcctgggttcaagtgattcccctgcctcagcctcccaagtagctgagactacaggcatgcgccaccatgcctggctagttttttgtactttagtagagatgaggttttaccatgttggccaggatggtcttgatctcctgacctcgtgatcctcctgcctcggcctcccaaagtgctgggatgacaggcgtgagccactgcgcccagaagattttctgatttttaaagttatgccagagaccgggcgtggtggctcacgcctgtcattccaacactttgggagactgaggttggcagatcacctgaggtttaggacttcgagactagactggccaatatggtaaaaccttgtctttactaaaaattcaaaaaaaattagccaagcggggtgaccgcagtcccagctatttaggaggttgaggcaggagaatcacttgaacccgggaagcagagattgcagtgagccgagatcgcttgaacccgagaagcagagattgcagtgagctgagatcatgccactgcattccagtctgggtgacaaagcaagactctgtcaagaaaaaaaaaaataaaaataaaaagccggaaatcaaattttaaatgttgggatctaatctaatttttttaaaaacaaaaagtatgcctaaaacaacagcaataacaacaagccatctatgggccaaactgtgggtggggaaacctattttgtacttcttattttatccgattgaattgtggtggagataggaaattgagaccccaaaaagggtagtaagttttcccaaagttatttagtcagttgccagattatggcttgaattaaatttaaattcttcagctgggcatggtggtgcacacctgtagtatagctgcttgggaggcagaggtgggaggactgcttgagcccaaaagttcaaggcacaggaagctgtgatcttaccaccacacttcagcctgggcaacagagcaagacctcatttcaaaaaaagaaaaaaaaaagaaaaatttaaattcttcattacagaacagctgatggtggaggtttattcttgggcaggtacatctgatctatttatgtatgtatctatgaatttgtctatttggcatggctctttagcaaaatacaggctttttttttttaagtaaaagtaattgaaacaaaatttgtttccaaggctggacagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggtacttagaataaagcctggcatacagaactgcagtttggttgttatccgtggtggtggcggtggcggtggcggtggcggtggcggtgatggtggtggtgatggtggcgatggtgatgatgatggtggtgatggtggtgatggtgttggcagtgatattggtggtggtgatggtcatagtggggaaggtgatgatgatgaatgaagatgattagaaagtcctcagttcacaaggtcagagtgatctagatgacacagggctcttcggttataagagaatatccttcagggttcctttaaatggctctctccatctttcgtactacagtgggacttgccacaggttctggggactgttaatgtgagatgagatgctacatacctttttgttgttggtgggtttttttgtgtgtatgcactgttgtgtgtgtgtgtgtgtgtgtgtgtgtgtgagagacagggtctcgctctgttgcccagggtgtagtacagtggcatgatctcagctcgttgcaacttccgccttccaggctcaggcactcctcccacttcagccgcctgagtggctgggaatacaggcacgctccatgctcagccactttttgtgtttttcatagaggcagcatctcactatcttgcctaggctggtctcgaactcccagcctaaagtggtctgcccacttggcctcccaaagtgctgggattacaggcatgagccactgcacctgacctgtatgctcctgttaagagagctttatttttatttatttattttgagacagggtctctgttgctcaggtgggagtgcagaagacaccacatacctttatcccttgttcctcatttcttagtctttctggctactgatctttttagtttgcgtgttcatcctgaaaggtccttggatatataggagccttgtctgtttcttcaaaccccgtggcagctggtttcatgctccaggcgagctcctgtcctctggggtgtgtcctgctgacccctcgcctgtgtttgtgttcgcaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgtaagtcactggggggtttcgttgtggggggtgggaaggtgcacctggacggggagtggtggttggtgataactgacatttctcttctacttagttgaccctaagttccttcttctagaaggcagaagaataatgtgggaggtgaaaactggagctctggagacaaacatgggtacaaatctttgctctgccgcttagtatttggcctcgagcaaattttttaacctccccaagcctcagtttccctgtttatgcaataggaatgataggcttgttctcaaggcattcctgggagattatcagctcttcccctcttactgagccgatctcctttttatttaattaaatatatttatatagattttttctggccaatttttaatttattttttgtagagaggggggacttgctgtgttgcccgggctggtcttgaacacctggcctcaagcagtcctcctgccttggtctcccaaagtactgggatgctcagtgtgaaccaccacgcctggcccctaattttttttttaagttggcttttattttgaaataatttaaagctacaggaaaattgcaataatgggccaggcgtggtggctcacgcctgtaatcccagcactttgggaggccaaggcgggcaggtcaggagtttgagaccagcctgaccaacatggtgaacctgtctctactaaaaatacaaaaatgagctgggtgtggtggcatgtgcctgtaatcttagcaacttgggaggctgaggtgggaggatcccttgaacccaggaggcagaggttgcagtgaactgagatagtgccactgcactctagcctgtgcaacagagcgagactccttctcaaaaaaaaaaaaaaaaaaaaaaagttgcgatgataccaggaactgctgcctgattttctctatccatcactcatagtcactgtttcctgttttttttttttttgttgttgttttttgtttttttttgacacaaggtgttgctcttttgcccaggctggagtgcaatggtatgatcacagcatactgcaaccttgaactcctggctcaagccatcctcctgcctcagctttttgagtagctggtagctgggactgcaggcatacaccaccatgcctggctaatttaaaacaattttttgtagagacagggtctcgccttgttgcccaggctgttgtcaaactcctggcttccagtgatcctcctgcctcggcctcccaaagtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgccctattgtcttccctgccactgattgagtggcagatgcccccttttgttgcgtttgccacactttgctcttgcattggctactttggtcacttatatactaactgcctggggtctaatggccttgagttttcactatctggcatagggggtgggttgctaagctaaataggaaactgctctgtcccgggggatacacaacttagtgagtgacagagacaaggaaacaactttattaattacagctggtgtgtattgagcacttactatgtatgtacctggcagtattcttggtgtttcacgtgtcttgaaattcattgaattttcacaacaaccctgtgagatgggtcctgctttgttcccatcttacaggtgaggaaaccaggcaagagaggttaagtgtcctgctcaagatcacaccactaatgtgcagccgagtcaggggtgggaccccagatgccatgcttttagcccctgcaacctgcagcttctgagccctgaacagagagttctcggagagtgtagcccttgagtattgtaaaaagaggagggaggctgggcatcgtggctcatgcctgtaatcccagcactttgggaggctgaggcgggagaatcacttgaggtcgggaatttgagaccagtatagccaacatggcaaaaccccgtctctactaaaaataaaaaaattagccggcgtggtggcacacgcctgtagtcctagctactcaagaggctgaggcaggagaattgcttgaacccgggaagtggaggctgcagtaagccgagatcgcaccactgtgctccagtctgggggacagagcgagacctcatctcaaaaaagaaaaagaaaaaaaaaaggagagaacaagtttaaggcaggacattctgagcagggtgaacagtgtgtccagggaggggtggaaggttaaggggaggatgcaggcagggaggacaaggtgttcggtgaaggaacacggtgtgaaggttggggggatagagtggatgtgacagaggggtcaggaaagacaacgtggagccaggttgccaaggaccatgaatctttatttttctaaattaatttttcattttttaaattttagagtcagagtcatactctgttgcccaggctggacttcactggcgtgagatcacagctcactgcaggcttgaactcctgggctcaaatgatccttctgcctcagcctcccaagtagctgggagtgtaggcatgcaccaacatgcccatctacatttattttttatttatttatttttttatttttccccccgagatggagtttcgctttgttgcccaggctgaaatgtaatggtgtgatcttgagttgccgcaacctctgcctcctggattcaagcgattctcctgcctcagcctcccgagaggctgggattacaggcatgcgccaccacgcccggctgattttgtatttttagtagagatgggatttcaccatgttggccaggctggtctcgaactccggacctcaggtgatccacccacctaggccccccaaagtgctgggattacaggcatgagccaccacccccggccagtttgttatttttgtagagacagggtctccctatgttgcccaggctggcctcaaactccttgtctcaagtgatcctcctgtctgggcctcctaaagtgctaggattataggtgtgagccaccatgccctgcccagaccatgattctatatagcacacatatgtgctgtccactctctgccaagaactgtcctaatccctttattaacccttttacgttgtaaataaggtaagcaaagtgtggtacagagaggagaaggactggcccaaggtcacctggtcagtaagtggtagagccagcttccagtctaggccccagcgtgtagcctggcacctgctttacgcctggctctcctgctgggtttgattcccctttgtgtcctcagagcctggccctgtgcctggcatgcagtaagcgttccataaatgcatggagggaatgagagagtaaagggctttgctttgtcctgaattcgggtcttgggctctgtgttctggcagtggggtattagagtggatttttttttttttttttcaatttcactataatagagacagggtctttccatgttgcccaggctagtcttaaactcccgagcccaagtgatccctctgccttggcctcctaaagtggtgggattacaggcatgagccaccatacgtggtcagctgtttttgacttgagtaggtcatcctcccttaacattccttgttcctggtcttttttttttttcctttgaggcagagtttcgctcttttttcccaggcgcaatggcatgatcttggctcactgcaacctctgcctcccgggttcaagtgattctcctgcctcagcttccccaataactgggattacaggcacgcgccaccacacctggctaatttttgtatttttagtagagatggggtttcaccatgttggccaggctggtctcaaactcctggcctcaggtgatccacgtgccttggcctcccaaagtgctggtattacaggcgtgagcaactgtgcctggccgttcctggtcttttgatcgttcatttatgcctctgtcaccctgggggaaacaggggtgatagtctgagggttggggcttttgactcctcaggggactctgagctgggctggccaagaggtgaactggcctgtgagatcctcagcctctctttatctacctgagatctctgggatggaatggaggaccaccagctcagctgtgaatgtgtcagaaacattctgactatatcccagggaaccaggatatgcaggcactggtaatatgggacaggatgcagccagcacatgttttttttttttttctttgagatagcgtctcactctgtcgcccaggctggaatgcagtggcatgatctcagctcagtgtagcctccgcctcccaggttcaagtgattctcctgcctcagcttcccagctagctgtgactaaaggcgtatgccaccacgcctggctaatttttgtatttttagtagagatagggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctggagcagagatggccgaggcagagagcaggggcgatggggcagaggctgaccccgggaacgttgagcatcagggcaagtgggttttgttttctgtactgggttctctgcctgttcttttaaataaagttttattggcatgaaggcatgtccattcattaacatcttgtctatggccactttcacactgcagtggcaaagctgagtagttttgatgtagtctatggcccatgaagtccaaaatatttattacgtggtccattaagaaatagtgtggctgggagcagtggctcacacctgtaatcccagcaccttgggaggccaaggcaagtggatcacctgaggtcaggagtttgagaccagcctggccaacgtggtgaaaccccgtctttactaaaaatacaaaaattagctaggcatggtggcgggcacctgtagtcccagctacttgggaagctgaggcaggagaatcacttgaacctgggaggcggaggttgcaagtgagctgagattgcaccactgcgctccagcctgggtgacaagagtgaaactctgtctcaaaaaaaaacccaacaactcctgtcttgtgcttctctcctcagctgcttgctacctttttaattcagctggagaggaggaagggagttcagtcttcagggatcatgctcactttctggctggtagccctagtgtgtgccctagccatcctgagatccaaaattatgacagccttaaaagaggtaagtggcagtctccttcctcatcttccttcagtggacccggagggagagatgctgggtccctctggcttgtgtagaagtcatgcgttgccatgggaaccaggggctgggtaccacatgcacctagcttctcccttggtgactttcctaccccaccaaatcctcactaaatcagccccagccttttttctagcacctcctttccccagggcctgatttgtctgtgttgctccaaggggctcccatgggacctccaagggcaggagctgtgggccgatgccaggctggccccatcagcaggaaacagcaagacaggcggctccaaattttgccaggctgggatggagccgagccgggaacggtgtttgcagagtgactgttcccctgggggaccctaggcttgtcctcgcgttacctttgtcccatcagttgctgctctggctggggaagttgtttacattggctgctgtgtgctgctgctaggaattttgaggagtgtgcacttttttttttttttttttgctgttgttgaggcggagtctcgctctgtcaccaggctggagtgcagtggcacgatctaggctcactgtaacttctacctcctatgttcaagcgattctcctgcctcagcctccccagtagctgggaccacaggcacgcgccaccatgcccagctaatttttgtatttttagtagagacggggtttcaccacgttggccaggatggtgtcgatcacttgacttcgtgatccacccgcctcggcctcccaaagtgttgggattacaggcgtgagccaccacgcctgacctggagtgtgtgcttttggaataacctgctgttcctgccatcttggagctaattagagactggcatgaggcaaaggaaggaaaagaagctgaacatttgactattgattgcctacatattattatgagtgatagcagctgatgctgattgagttcatgttttcaaagtgcctcgcaggggactgtgtatgtgtcacgaataatcttcctgacctcttgcagtgacttggacagaatttctcagcctcagcactaatcgacattttggattggagactcgttggttgtaggggctgtcctgtgctttgtagacatttaggggtgtccctggcttcccctgactgggtgccataacactcccaagttaccacaaagaagatatccccagacactgccagatgtttcctgggaggcagaatcacccctggttaagaaccaccggtggtttataggtggggaatctgaggcacagaaaggttaaataagttgacaagatcccacagccagtgtgagagagccaggccttgatacagctctgtttcactcccaagccctgtcttcctcccatcaggcagcggtgagcagtgagactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattatactggcatgctttcctcacttgtggcaaatgcctggcccctgagggatttgagtgtgagatccttggtctattttgtcagtttcagagaaattctgtaaatatggaaacttatcagtgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctgggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctccccaacttggcttacttttaattaattaataattaaagatggggagatggtctcaaacccctgggctcaagcgatcctcttgccttggcctctcaaagtgctgggattacaggtgtgagtcaccacgcctcgcctattctttatttttttaaatagagatgggatcttgctgtgttgcccaggctcatgtgcagcttttgataagagagatctgggaaggcctgcccagaaaactgcatgtgagcggagacctagaggggtgaggtagtgggtggagcaaacacctagaggaagagtgttccaggcagaggggaataagtacaagggccctggggtggggaggtgtggagagaacagcaagaaaagccagcacagcaggagaaggctaagagacagtgggtgcctgagaggtgggacagcccccttgtgagccagatgagctgtttgggttttattgtgagtatggggcagggaggccttggagcacctatttgatgctgattcatggctagtcagctggtaatgggcggattgcagtgggagaacttttcacctctgtggttctgttgggtttggcctaaacctctgtgaggggcagaggctcaccttgtgggtgacgaaagggcttggtgggcatcagtatggaggaggaggttgatgataactaagagattttagaaacctatgtctcaggccaggtgtggtggctcacacctgtaatcgcagcactttgggaagctgaggcaggcagatcagttgagttcaggagttcgagaccagcccagccaacatggtgaaatgccatctctgctaaaaatacaaaaattagccaggcatggtggtgcatgcttgtaatcccagctagtcgggaggctgaggcaggagaatctcttgaccctgggaggcggaggttgcagtgagcagagatcacaccactgcgctccaacctgggtgacagaatgagactctgtctcaaaaaaagaaaaaagaaatgcatgtcccagtgtatgttctgaggagtcccgtgttggtatttccttgcccaaagaggagctgggttggagaaatgagcaagtgcacacatctgtgtatgtattcctgtgcatctgtgtgtacgtgtgcatgtgcctgcttgtgtgtctcggtagtcataggcatgtatatgcgtgtatgtgcttatatgtgaatgtgtgcttgtgagtgtgtttatgttcatgtatgtgtgtgtttgtgtgtgtgtgtgtctttgtgttgtgtgtgcttgcatatgtataaagttcacaaaggcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggctggtctcgaactcctgacctcaagtgatccacccgcctcggcctcccaaaatgttgggattacaggtgtgagccaccgtgtctggccgagccattctttagaactgggatttatacaaaacaagtcacacctcaactgggtggctgcagaccttggattgctcagggtaaacagagtctggttggggctgcctggctggcgtggggatcacccaacccatcaagcttcctctgggagcctgggaagagctctcttgccatggatggttctggaagctttttgaaggagggactttcttaatttctgatctcccttgggaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggttcaagcaattctcctgcctcagcctcctgagtaactgggactacaggcgcacaccaccatgcctggctagtttttgtatttttagtagagatggggtttcaccgtgttggccaggatggtctcgatctcctgacttcaagtgatccgcccactttggcctcccaaagtgctgggattacaggcttgagccaccgtgcccggctgtggtctgcctcttgtgcagtgagatccagcagggtgtcaaatgtgggtgtgcaggctgctgcatttctgacatttgtgcacctgtccaggagagaacactttgattggctgacactctctgtccaggaagcctgaacttccctctgggttcctgttcaggaaccccatggggttgccatttacctttttgcagattagagtttagaccaggagttagccagtagcccatgggccgaatctggcctgctgcctgtttttgtaaataaagttttattggaacacagccactcgcgttcatcacatagtgtctacaggtgtctggagctgcagcagtggagttgtgtagttgctacagagactgtagcacccacaaagtctaagatacctaccatctgaccctttacagaagaagtttgtccacccctggtctaagcatttctttagctctgatgactttttagcttccttttttgtcccctttccatttgcaggcattctttcttcctatgcaaggcaaggacgggaatcgacatttattagatgcttgcggtgtactggctagcactatgctaagttctttatatgcatgtctcacttgactctcacagcagtcctggtgaacttggtactatttttctcattttacagacaaacaatcgcagacataagtgccttgctcgacctgagtagtagagcagagattcgaactcacgactggctgttgtgcacaatcatgtcacttcgcttggttgtaactgctgaatgggagggtcttggctaaataatggctttgtgttaggctagaggcttcacgtggcagtatccaccttgtaacctcagtgcctaagacacagccaggcacacggtgggcctgtagtggtaatttattgttgtgttatatggggaggtgctcagtacatgtggcacgtatattatgtcttgcataagggtgaagtgtgcatgaggcctcacaggacatcagattaagctgcttctctgccttcatcctgttcaagtattaccagcaagaaagaggaaggggactgatgtatgcacagatgttctgaaggcttggcatggtgtcaagagccttatttttttttttaatgttgcattttggggggttaaatatatgtaacctaagatttgccattttaaccattttaagtatgcaattcagtgatgctaagtgcttttaaaaatcttgttcaaggccaggtgtggtggcttacacctataaacccagcactttgggaggccgaggcaggtagatcacctgagatcaggagtttgagaccagcctgaccaacatggtgaaatcccatctctactaaaaatacaaaaattagctgggcatggtgttgagcacctgtgatccctgctatttaggaggcagaggcaggagaattgcttgtgcccgggaggcggaggttgcagtgagctgagatcgctccagtctgggcaacagactgagaccctgtctcaaacaaacaacgaacaaatgaacaaacaaacaaacaaaataaccacataactacctagcaacgtagcctagcaattgagatgggggcaaggaagggtaggaaccaggtcctgtgagaatcagctagacttgtggctttgggctcggtgctcttcctttggggacgtcagcagccccttcttgaaaacgggttgcaactcgatttgttgttggcttcacctcctctctctgtcccagacctgagccctgtgatctggggaggaggacaacgggacaacctgtttgcttgttttcccatcactctcagggattgaatcacagtggagccaggaagatggggagagtccaggcttgctgctctcccatcctcagagcagcagcaggccatccatcacctgtcgcctgtcctcagagtgatcagccaaggcctggggcggctggggtcaggtcaggcagggcgtgggtgggagctggcagggctggctcctccaggccacttcgtgctgagtcactgagtcggccaatcctccccagctggccctgctcccactccatgactcagatgtctattccagccctggctgcttggtggggctcctcccatctgtccttctggctctggggctgccgaggcttttgggagcctgggcagggctgaccaagactgccagagctccggccggtccccagtctcctgccttttttctcattggcactgagtctgtggtttaggtttgggggaggagggtcttgtagataaggggatcaaggccaaaggagatcatttattaggtcccagctgaaagcagaggtccttggaccagttggaatgctcgacatcccccggaagcttgctagaaatgctgggtctcaggcctcatcccagacctaccaagtcaaactcattttaacaagatctccaggtggttcagggttgcaaatcactggtttggaacattcagtgaaagctactcagctcgtttgcagtaagaggtatttttagtcctgtctgtataatatgtaatattttccccccagcattttactatgaacattcttaaacctacagaaaagtcgaaagaattctactgtgagcagtcatatagttggtacctagagccacagttaacattttgctaaacttgctttgtcacatatctgtctgtctaaccagatagctaatcagccagccaaccggctacttttgttttgttttttgtttttgagatagggtctcactctgtctcgcagactagagtgcagtggtgtgatcatagctcactgcagcctccaactcctgggctccaatgatcttcccgcttctgcctcccaggtagcttgggccctacaggtgcacactactgtgtttggctaatttttaaattttttgtaggcgtgagggctccttatgttgcccagtctggtcttgaactcctggcctcaagccatcctcccacctcagcctcccaaaatactgggattacaggcctgagccactgaacctagtttttttgatatctgaaacttccttcgaaatatattagtattctttcatgcacccacttccaagtaaatcattagctagagtttaagatctgtttacacttctgagttttttgcttaaaatttacatacagtgaaattgctgatctcaagttagcatttgatgaatcttggtaaaggaatactttaaacccctgtcaagatatagaacactgcaaggacgccaggaagttccctcgtgccccttcatgatcagtctctgtccccacccaccaaggcctgatcttggaccgttgattaaagcgttgaaactccattttctttccatttctccgtcatgctttcagtcatttaataatcaggtgttgtgccaggggctgagctagaaagaaacagaccttgaccactgccctggaggagagatggaaggtgggtggcaggcagttgaaccaacaactgcaggatggacagtgggggctctgagggagggaagtgctgggagttgtgggggctgggagagtggtccctgactcagcctggggctccagggctagcatccagggaggagaggggatgctcaagtctaaggaatgcgaggctctggccaggtgaatatgtttggaggtggtggggtgggagggtgctcctggtagagcaactggcatgtgcaaaggtccagttgagggagcttgtgggtgttgggaatcacttggaattcggcttggctaggctgggtgcagtggctcatgcctgtaatcccagcactttgggaggccgaggcaggcagatcacctgagactaggagctcaagaccagcctggccaacgtggtaaaaccccgtctctactgatcataaaaaaattagctgggtgtggtggtgcatgcctgtaatcccagctactcgggaggctcaggcaggagaattgcttgaacccgggaggcggaggttgcagtgcgccgagatcgcgccactgtactccagtctgggcgacagagcaagactctgtctcaaaagaaagaaagaaaaaaagaattctgcttggctagattggaagggctaggatgtaagcgaaaagagaggcaagagtcagcatcagagatcaagggtgcaattatgtgtcacaataaggacttggaattttttgtttgtttgtttgttttgagatggagtttcactctgtcaccaaggttggagtgcggtggtgccatctcagctcaccgtgccctccacctccggggctcaagcgatcctcccacctcagcctcgcaagtagctgggaccatagttgcgtgccaccacgcccaagtaactttttctgtttttggtagagatggggtttctgtatgttactcaggctggtcttgaactcctgagctcaagtgatgccctgccttggcctcccaaaatgctaggattacagggatgggtgaaccaccacatccagccaggacttggaattttaaccctactgtggtgggagctgaggaaaggtttttcaccagtggaatgacacactcaggttggacaggttgtggaagatcctcaggctcaaaggaagaggatacattggacatgggggtgaggtcggtggcacttaaaaagcctttgcaggcacccaggcaggtagagagggaggctgagccaggatattcccctgtgcccactacagcatcaaaaaccagaaaaagggccaggtgcgtggctcacacctgtagtcttggcattttgggaggcttaggggggaagatttcttgagaccaatctggtcaacatagtgagaccccatctcttgaaacaaaaaaacaaagaaaacagacaagttgatgggcaaagggcatgggcaaagattctggggtgtgctccagtagaggaaacggaggtcctgggcagggaggcattttgcacagttggtaagcaacagggcaaacaaatcaccagtgtttacgttatactggcaaatctcttactgctggacatttaggctccgtctaataataaggataacagctgggtgcactgtattatttatttagtcctcacagtagggcaggatgatcagtctccccacttgacagatgaagacactgagggtcagagtggtgatgtgtcaggaaccctcccactgggttctcacgcttgaaacacagattgctggtccccacccacacagtttctgatgcagtaggtctgggtggggcccgagcatctgcggttcccaacaagttcccaggtgccaccgatgctggtgacagagctgcgtttgaggatcactgctctaaacattattgctgctgcacgcattgcctcctgctgggtgcaggggttgtggggggcactttggcagtgcagagcggaggtaaccagcagaaaacccgttagaactaaaagctgagagtgtttctgacaaacaggtcaacatgctgaaagacccagacaaggtccttaaactaccctgcgctccaagaatcagtgcctggggctgccgtacctaattggttcaaaccacagggtttctggccagctcatctggtaccaaacgtagatgtcaatatggtggatgccaaagaacacatcactctgtttggatgaatcaggcttttcctccctctgccttcagccaggacttctctgaattgttttcatttcaaatgaaagagggaccagttcacaagctgctttcatgctatctgggacaggagttactgtatttcagtgtctgaggctgggaaaccccctggaggtggctctgtcttttgtacctagtgtgtgatgtcaaaagattctccttggtttgggttaaatgacatgctccctggattacaatccagtgccccatgattttttttcctccttttttattgtcaatccttgacctacttcagaagttagttgtctttgttgtcaagtaaggccttccacgtcagatagaggctgtttccaggccgggtgcagtggctcatgcctgtaatcccagcactttgggaggccgaggtgggtggatcgcttgaggtcaggagtttgagaccagcctggccaacatgataaaacccccgtctgtactacaaatgcaaaaattagccaggcatggtggtgtgcaccatgtaatccccgctatgtggcaggatgaggcaggagaactgtttcaatttgggaagcggaggctgcagtgagctgagaacgcaccattgcgctgcagcctgggcgatgagagtgaaaccgtctcaaaaaaaaaaaaaaaaaaaaaaaggctatttcctttttttttttttttttttttttgccagtgaaggggggaccctgtgttggcctccctatcggtcacttgagataatctgaaaatctgtgtttagatccatagaagagaggcggcctgaggagaagaatttgacaaagctctttgagtgtgcaaattagaaatggcaattgctgggcgcggtgggtcatgcctgtaatcccagcgctttgtgaggccgagataggcggatcagttgaggtcaggagttcgagaccagcctagccaacatggtgaaaccccatctctatcaaaaaatccaaaaattagccaggtgtggtggcagatgcctataatcccagctactcaggaggctgaggcaggagaattgcttgaacctgggaggtggaggttgcagtgagccgagatcgggccactgcactccagcctgggcgacagagtgagactcagtctcaaaacacaaaaaacaaaaaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaactccgctgtgtagctcaaaagctgccatactcatttataatacataaatgaatgggtgtgactgttccaatgaaactttatttataaatagctggtctgtgggccatagatgcttctgatatataaagcatctggtatagtggtgtattgtgaacccactggggttttttcccccccaaacacttgagctttattgatgtatattgacaaataaaaatggtatataggttgggcacggtggttcatgcctataatcccaggactttgggaggccgaggcaggtggatcacttgagctcaggagttcgagactagctcaaggaatagagtgaaattctgtctctacaaaaaatacaaaaattagctgggtgttgtggtgtgcgtctgtagtcccagctacctggggggctgaggtgggaggatcacttgaacctgggaggtcgaggctgcaaagagctatgattacactaccgtgctccagcctgggtgacagagcgagaccctgtctcgaaaatatatttaaggtgtacagttttatgtttccatataccagaggctactgtcactgcttctattattattactactactactactcatgttaccctttctttggctgttactttgtgccaggtactattctaagtacttaccatgtttgatctcatttaatcttcaccaccaaggaactgacccaaggtcccacagctaggaaatggcaagctgggattgagccgtgccagctagccccgtgctatgcactgcttcacacagaagctgcccctccacccctgccgccttccttttcctttgttcctttgttatcagctggccgtttccagaaacggttggttaacctctgcctacctcaaccctcagtgattaaggggtgatatcgggcctcaaatgactgacctttttcctttgttgcagctctcactgattgtaattctgattgtaattatatatttgtttgcaccgtggtttacttactgtccatcttccccagggcaggaggctgaatggggcaggggtctcgctgtctcgtttgcagctccgtccgcggcacttcacccacatcctggcctataagcaagtcctgcccatatatttgaccaataaataaatgaatcattgacagccgtgccccaccccttcctcctctctctgccagccagcaccttggtctttcacagtgggtagagggcttgggctgcaggtgaaatggatttgcaattccctgataacccacccgccgactgtgggagtgggcaggaaggtgtcagctcttccggatgaaaaaccagcctgcaatgcagtgtttctacccagcctacaaagcaaacaccactacctccacgccttaggttggagaaattccgctttacgacacagtcccatgggcctcatgtcatttgtccctcctggcagtcccgggggataggtcgagcaagcagtaggacaaacgactcccattttccaggtgtaaaaactgaggcttggaggtgaagggacttgcccaaggtcatcagctagaatatagcagggctgggattagaacccaggtctgtccgggtccacggtctgatctgaactcggcttcagttggtctggaatgcaccggctgcatctgatgatcttattaaagatctgtggctgtcagggtcctccccctggaggtgctgatttagttggtctgggttggggccctaggcacttggcacttaacaaactccttaggtgattccagtggacaggcagggctgggaacttcatcacccctccgagccccagagcggagcctgatccttagccctggctgtgtatttgaatcactggaggagctttttatttagccttttatgatggaaacataaagtagacagcctaggataatgaactaccatgagctctttttcttttctttttatttatttttgagacagggtctcactattacccaggctggagtgcgatggcacaatctcagcttgctgcaacctctgcctcccgggttcaagccattctcgtgcctcagcctcttgagtagctgggactacaggcacgtgccaccatgtccggccaatttttatattttttgtagagacagggtcttgccatgttgcccagactggtctcgaactcctgaactcaaagcagttctcccgcctcagcctcccaaagtgttggggttacaagtgtgagccactgcgcccagctgccatgagctctttaccatgcattgcataggtgaacgttttaatatgtatctctgaaggacatggatttgtttattttaaatgactttttatttcgcaatagtttggctcacaaaaagttgcaaaaataacagagttcctgttgttcattgctcaactttctctaatgataacatctgaaagataagaattttaaaaactgtaactgttgggctgcatgtgatggctcatgcctgtaattccagcactttgggaagctgaggcaggaggatcacttaagcccaggagtttgagaccagcctgatcaatataggtagaccttgtcttgacaaaaaacatgtatatgtgactgtaatactaactttaataataattcattattatcaaatattccagtaatccattgtgtttgtacaatggctcattcttctatgatatcattctttatgttttagctgggatttttttatggaaaagagtttccccttcatttctttgatcactgatcactctgtggtgatcgaataaatgactgttttcctcagggaagccttctccaaccctggtgaaccaaatgagtacatttgggaaaggtggagaaaatacttgtttctttccgctttttctgcgttcaaacaatgacctggttcactgacaacatcagatgtttctctttatttccagcgtcaatatgaaatttgtgtacataaacatgtaaggctgggcgcagtggctcaagcctgtaatcccaccactttgggaagccacggtgggcagatcacttgagtcaggagttcgagaccagcctgttcaccaacatggtgaaaccccatctctactaaagatacaaacattagcccagtgtggtggctgatgcttgtaatcccagctacttaggaggccgaggcgggaggatcacttgaacccaggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagcctgcagcggccacttctgcttggctcttgagccttttaacaatcctgttcatgcttagtttccttgttgtccggtgtgacaagatgttcttggcttaccttgcatatttcctgcccagccacttttccaagaaaaatctggaagtttaaaacaaaaacaaagcttcagtgccccagtcgcacccagaaccagcttaatcagattgcctggtgcgggtagggcccggatacagtatttttttaaattttatttttattttgtttgagacagggtccctaggctggagtgtagtggcacgatctcagcttactgcaacctccgcctcatggattcaagcaattctgcctcagcctcccgagtagctgagcttgcaggcacccaccaccacatccagctaattttttgtatttttggtagagacgaggtttcatcatgttgcctaggctggtctcgaactcctgaccacaagtgatctgcccgccttggcctcccaaagtactgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaagccaggctttgtctgtcatcccaggagctctgtatcggtccctttccttgcctgcatgttgttgacttggggctcatcttcatttctctgggaaatgagttctttgatagcttgcttagaatctctcagtacttcccattgcccttagaatgaagaccaaaatatgtggcctgcagtgtagactgtgcacagcctccagtgtagactactcaggccccttcttggttcctggagtctaccatgctttcttctaccaccgggcctttgcacacactgctgtctgttgggaatgcgttgcctttccttgttacttagttctcatctactcacccttcaggtgccagcttgactgtctgcctcgggggcgccttctctgaccttcgtacaccagatcagcccccatgcacttactttgtctcattggtaatatttctctcccttcaggacacacatcaaggcccagaagttgtagttttgcatttgttcatgtgatcatttgatgcatgtctctctctggagcctgactctttggggctcacatcctcactccaccgcttttagctgtgggaccttgaacaaatcttttcatctctggtccccagtttttaagttaaattaaattttattttatttttattttgagacactcttgctctgttgccaggctgtagtgcagtcgttcgatcatggctcactgcaacctccgcctcctgggttcaagcgattctcttgcctcagcctcccaagtagctggaactacaggcgcctgccaccacatccagctaatttttgtatttttaggagagacagggtttcaccatgttggctaggatggtctcgatctcttgacctcatgatctgcctgcctcggtctccgaaagtgctgggattacaggcccagtttcttttaactgcaaaacagggatgatataatacttttatttatcttgtgaggtgaggatgaagattaaataaggtagtttgtgtaaagcacttagaaaagagctagctactaatagtagagaatcttggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatttgggtttttaaaatattaggtatagttattattgacattgtccccctcctgtcccccacgccttagaaaaataatactgtctcaccacaggaagtgtgggttaaaaaaccacatgtgcagatcagcagtgcaggagacatctagaggtaaccagtgtcaccattttagtatgccttcttctggtcgtctttcttttttttttgagacggagtcttactctgtcagtctcagctcactacaagtctccgcctcccaggttcaagcgattctcctgcctcagcctcccaggtagctgggattacaggcttgcgccaccatgcccggctactttttgtatttttagtagagacagagttttgccatgttggccaggcttgtcttgaaactcctgacctcaggtgatccacccgcatcgacttcccaaagtgctgggattacaggtgtgagccaccatgcccagctaccttctggtcctctttttgtatatctttttctgcccgttgttaacatcttagtggggattgtttgaagaatctttttttgcccctaataagcatcatcttttttttttttttttttttttgagacaggctttcgctctgtcgctgaggctggagtgcagcggcacacttgtagctcactgcagtcccaatctactgggcttaggtgatgctcctgcctcagcctcctgagtagctggggctacaggcacactcccccatgcccagcagatttttgtactttctgtagagatggggtttcatcatgttgcccaggctggtctccagcttctgagctcaagtgattctcccgcctcagcctccagagtgctgggattacaggcgtgaaccaccatgcccggtctcatccttgtcttaatgacaaacatcgttttaaaaaattagatgttttaaataatttcttcaagttactattaaaaagcatcactgggacagttgatgtaatttgttcatgactacaggaccccggatgcatgctaataacattcattcttgttttggaaaattgtgctctagttacataagagcatgtcctggattggaagagaatacctccagtttttcttgggtaaaggcatgtagaggctgtatgttaactttttttttttttttttttttttttgagatggagtcttgctctgtcatccagggtgcagtgcagtggcaggacctcagctctctgcaacctctgcttcctgggttcaagagattctcctgtctcagcctcctgagtagctgggattacagggacctgccaccacatccagctaatttttgtatttttagtagagatggagtttcactgtgttgtccaggctggtctcaaactcctgacttcaggtgatccacccacgtcagcctcccaaggtgctgagattacaggtgtgagccaccatgccagccctttaactgtttaagtggttcagaaaaagatgatgtgtttgcatgtgtgtgtgtgtttgtgtgtgcatgtcaatggatacagacagagaatgatactgcaaacgtggcaacgtgttaacaatggtgagttgagtgaattcttagtatgatttgagtaatttttctataagtttgaaattattttagaacaaaacatgaaagtattttaccttttattataaaagtgtttagtctgctgggcacggtggctcatgcctgtaatgttagcactttcagaggccaaggtgggtggatcacctgaggtcaggagttcgagaccagcctggcctacatggtgaaaccctgtctccactaacaatacaaaaattagccgggcagcacacgcctgtaatcccagctacttgggagggtgaggcaggagaattgctagaatacaggaggcagaggttgcagtgcactgagatggcgccattacactccagcctggatggagtgacatagaaagattaatataataaaactcaataatctcatcacccagatttcatgcttactaatgctttgtcatgtcagcctttttattttttaattttttccttcagcctatttttttttttttctttttatagggtctgactctgttgcccaggctggagtgcagtgacacaatgacggctctttgcagcctccacctcctggccttgagcaatcctgccacctcagcctcccgagtagctgggactacaggtgcgagccatcatgactggctaatttttttatttttacttttcgtagagatagtctccctatgttgtccaggctggtcttgaactccagggctcacaaaatcctcccacctcggcctcccagagcgctaggattatagacatgagctaccgtgcctggcccatatcagccttttttaatttaaaattttaaaaagttggcggggcacggtggcttatgcctataattccaagacttcgggaggccaaggtgggagggttgcttgagcccgggggttcaagaccagcttgggcaacatagggagactcttgtctctacaaaaataaaaaataaaaaaaaaattagccagtcataatggcttacacccaaagtcccagctactcgggaggttgagatgggagaaccactctagaccgggagctggaggctgcagggagctgcgatcgcaccactgtactccatcctgggtgacacagcgagaccctctctccaagtaaataaatgaatgaacgaataataaaaaataaaaaagagctatcctgatacttcgctcctaaatcatctttttttccctaagtcttttgtatgcaccactaaaaaaaaaaaaagccatttttcctgcatgacccaacagaatgagctgtaattagcttgtaatatatgcaaatgtccatctgcattctgacttcccaagctgcatggctgccttcatttgcagcgggcagctgtgctgcagaggggagcagcatcagcaggcgtgtggagtgagtgagccccgtcctccccctcctcctgtcattgactctcattgcctaacccccttgtgtcttggccccaggttgattgtccggggctaccgccagcccctggagggcagtgacctctggtccttaaacaaggaggacacgtcggaacaagtcgtgcctgttttggtaaagaactggaagaaggaatgcgccaagactaggaagtaagtgtgagtttccttgtcctccaggatgccctggtcacctcctttccactcctgtggcctcaatccaggatggggccctggcagtgctgcctgttactagctttgtggttctgggcaagatgcctcacttctcctcctggcctcagtttgcttttctgccaaatggggtaggatctcacatgtcattaaagcaactgggcagagaaaagaagaaagaagctgggtgcggtggctctcgtgtctaatcccagcactttgggaggccaaggcaggcggatcacttggtcgggagtttgagaccagcctggccaacatggtgaaaccctgtctctactaaaaatacaaaaattagctaggcatggtggcaggcgcctgtaatcatagctactcaggaggctgacaggagaatcacttgaacccaggaggcggaggttgcagtgagctgagattgtgccactgcatactagcctgggagacagagtgagactccgtctcaaaaaaaaaaaaagaagaaaaatgttgtccaaacaggcagttgatgctgtctgccatggcgcgtgactatccctccttgagtcagtctcacttttttctgtctctttctgagcatctggcatcctgcatgttcttgctgtttgaatgttctgtccaacatgcccagctgaccacgtaagtctgtttagccaaagaagccccatttgagggtgattttggctgtactggattttaggctctaccccctatgtaaggcgtgccccactgcaccacctctgtcactcttcgggaatcaggccagtgcctcccctgcacataccttaactcatcaaatctgagacaccattagttgcgtgatgcgttattattctatgtaacagtaagaaagaaaagcagctgccaattaaacaaggacataagacttgtctcgagcccggacgaactggaacatgaaattgtgggtgacatgggggcagtggattgcggccatgggggtagtagaatggctgtttttgttcctgttgcctgttctggggtaagtttactacgataaactgtggtggggccagtgtggtgcattggattccccacagacccattggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacctgcagcatcccccccgctaagcaggccacatttgtagtgtgggcttcagcattcctcatcatccacgcctctgctgatcacctggctcggcttcctctcatggaagacggatgcccacctttgtgtcccctggagcttgtcaggagagcaggttgctggagacaccatgggagaggccaatatcacagccttgggaggaggacagagtttgaatccagaagctcctccactggcctggctcttaatccactgagcagatgaaactgactgctgcttttgtgcttagcgacgtttagtccctgagggttcagagagtggaacaaaagagacacactctagttgggtgccatcgacattctatatgggagacaggacgttggttgtgaaacatgcattgacaagaagctttggagaatgatggtgttggggtgagataaaaatgaggaaatgagggtgagagtaaccgaggaagcttttgtgtgtgtgtgtgtgtgtgtgtgtatgtatgtgtgtgtgtgtgtgtgtgtgttttctttttttttttttttttttgagatggagtctcattctgttacccagggtggaatacagtagtgtgatctcggctcactgcaacctctgcctctcgggttcaagcaattcttctgccccggtctcccaaagtgctgggattacaggtgcatgccaccacgcctgactaattttttgtatttttagtagagacggggtttcaccatgttggccaggctggtcttaaacttctaatctcaagtgatcctcctgccttggcctcccaaagtgctgggattacaggcatgagctactgtgtccggctgagagaggtgttttagatacagtggtcaaaggttctacccagtgtggccatgacccttggtgagcatgtgcctgtccctccctaagtctatctctggctgttttcgagcctctggcatcctgagtgttactgctttttgaagtgtttttgttcaacatgcccagctgaccatgtatgattgttttgagaaggtcacatttgagcagagacttgcattggagggagtgagccttgtgtgtatctggggaaggaagggctttccaggtagagggagcagccagtgcaaaggctctgaggacactcgtggtgcatcagggggcttgtgtggcttgaggaaagtgagtgagggggagaaagggaggagatgaagcaggagaaggatttgcaggggtctcctctgagagttaaggtgggattccaggtgcagtgagaacacaggcgcaggttttctgcagggcagtggtgtgacgtgagttctgttgtttgtttgtttgtttgtatgtatgtatgtatgtatgtatgtatgtatgtatgtatgtattttagagacagggtcttgctctgttgctcaggctggatggcagtggcatgataacagctcattgcagcctggaaattccgggctcaagcagtcctcccacctcatcctcccagagtagctgggattacaggtgcacaccaccatgcctggctgatgaattaattaattaattttatattttatatttgtttttttgagatggaattttgctcttgttgcttaggctggagtgcagtggtgctgtcttggctcactgcaacctccaccccccgggttcaagcgattttcctgcctcagcctccggagtagctgggattacaggaatgtaccaccatgcccggctaattgtgtatttttagtagagatggggtttctccatgttggtcagtctagtgtcaaactcctgacatcaggtgatctgcctgcctcggcctcccaaagtgctgggattacaggtgtgagccactgcgcctggcctttttaaatttattttattttattattattatactttaagttttagggtacatgtgcacaatgtgcaggttagttacatatgtatagagacaggtctcactgtgttgcccaggctggtctccaagtcttggcttcaagcagtcctcctgcctcagcctcccaaatagctgggattacaggtgtgagccaccacacccagctgagttctggttcataacaacccaggctgtcctggggaaggtggatatttagggacaagagtgaaggcagggagaccagggtgggaacctcaagggctgtccatgaagtcccttcatgcctcaccgggagccgccattgtatttatttatttattttttgagacagggtgtcactcttttgtccaggctggagtgcagtggcacgatctcggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaaaaacccagtgcttcattggtttgtgtgtagtggttttatgttctcttttgtgtatggccactcagagcttagggccattttggactgtggtttctgctggcatgaatgtgaaatgcttctgtgactctggaagagtttggcagttttttttttttttttttttaagttagacacagtgaacataccaccagtcacccccttcccaggcatccagccaacagagctgagaacatatgttcataaaaggctggtacaggaatgttcttagctactttgtgataacccaaactggaggtaagccagacatctattagcaagtgaacagacagatgcaccagttatgtacatctgcacaactgaatactaagtgatgtacaagaacgaactattggccgggcacagtggctcatgcccataatctcagcactttgggggcccaaggcaggcagatcacttgaggtcaggagttcaagaccagcttggctaacatggtgaaaccctgtctctactaaaaacataaaaattagctgggtgtggtagcgcacacctgtaatcccagctactcgggaggctgaggcaggagaatcgcttgaacgcaggaggcggaggttgcagggagtcaggatcgcaccattgcactccagcctgtgtgatagagcaagactccatctcaaaaaaaaaaaaaaaaatccctataagataaagactacttttttggtgacagctttattgagatattcatacaccgcacaattcatgtatgcagaacatacaattcactgatttttagtgtgttcacagagttgtgcagtcatcatcacagtcaattttatttatttgctttttaagacagagtcttgctgtggcgctgaggctggagtgcagtggcacaacctcggctcattgcaaccccctcctcctcctgagttcaagcgattctcctttctcaccctcccaagtagctgggattacaggcaaccgccaccatgcctggctaattttttatatttttagtagagacaaggttttgccatgttggtcagggtgttctcaaactcctgacctcaagtgatccacccgcctcgacctcccgaagtgctggcattacaggcatgaaccactgcacccagtcaaaaaaaaaatttttttttagaaatagggtcttgctgtgttgctctggctggctggactgtttttttttttttttttttttccactgatgtatatatgcctatccctttacctgtcttgatgattgttgttcttttttttgttttgtttttttctttttgagactgagtctttttgcccaggctggagtgcaatggtgtggtctcagctcaccacaacctccgcctcctgggtttaagcgattctcctgcctcagcctcccaagtagctgggattataggtatgtgccaccatgccgggctgattttgtatttttagtagagatgaggtttctccatgtttggtcaggctggtcttgaacctgccgacctcaggtgatctgcccacctcggcctcccatagtgctgggattacaggcgtgagccactgcgcccagcctattgttgttctttctttttgagatggagttttgctctgtcacccaggctggagtgcaatggcctgatctccactcacagcaacctccacctcccaggttcaagtaattctcctgcctcagcctcccaagtagctgggattacaggcacctgccatcatgcccggctaatttttgtatttttagtagagatggggtttcactatgttggtcaggctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagtaagaccccttccctcccaggtgggctccattttccctccttggctttgatctttcagttgcatcagtcataaccctggggtcatgctgtgtcctgaagtgggctcatagccagatgtctccatttttactttagcttttttgaaaaaaatagagacagggtcttgctttgttggtcaggctggtctcgagctcctgacttcaagcgatcctcctgcctcggcctcccaaagtgctgggattgcagatgtgagccatggtcactgcctagctttactttatgctttacttaattaccatattagtgaagaccacatcgtttgcaagtaacagaaacccactaggctcccctaaaacccaaatggggaggatatggcattgtcttgggaaaccaagagcaaggaaatgccagcagatctcatgaaaaaactgcaaccagggttgggcgcagtggctcatgcctataatcccagcactttgagaggctgaggtgggaagatcacctgaggtcaggaggtcaagaccagcctggccagcatggtaaaaccatctgctaaaaatacaaaaattagccgggcgtggtggtgcacgcctgtaatcccagctactcaggaggctgaggcataaaaattgcttgaacccaggaggcagaggttacagcaagctgattgcatcactgaactcaaaccttggcgacagagcaagactttgtctcaaaaaaaaaaaaaaaaaaaaaaagaataaaaacaacaacaaaaaactgcaaccaggaactggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgaccggctaatttttgtatttttagtagagacagggtttcgccatgttggccaggctgatcttgaactgctgacctcaggtgatccgcctgcctcagcctcccaaagtgctgggattacaggcatgagccaccgcgcccagcctgttgtcactcttaatttgaactgagcaggtggcacattccttgcatggtaagagtatgtagcaggcatttgtgtacatccaatttcaaaggacctaaattaccttcttgatccctataaatttttttttttttttgtctcgaggtcaaggaaactgcttggctcctaggttaggaagagacagtcttgcaggtacttgatgaactagaggagtgattctcaggcctgtctgtgaattagactcacctggggagcttaaactgatgcaggccaggcactgtagctcatgcctgtaatcccagcagcttgggagaccaaggtgggggaatcactggaggcttggaagttcaataccagcctggtcaatatagcaagaccctggctctgcagaaaatttaaaaaaattagccaggtatggtggtgcgtacctgtagtcccgtctactcaggagattgagttaaaagaatcacttcagccccggagttggaggctgcagtgagtcctgatagcatccctgcattccggcctgtgtgacagaatgagaccctgtctgaaaaaacaaaaaaacttcctgacacctaggttgcaccagaccagtgaaattgcgattgctgtggtggcacccaggtgtcattgtttttgttttttatttatttttatgttttgagacagggtctcgctctgtcacccaggctagagtgcagtggcatgatcttggctcactgcagcctccacctcctgggctcaaacgatcctgccacctcagcccaccacgtagctgggcccagaggcatgcatcaccacgcctgctaatgtcttagtgtttttaaaactcacgaggtgatagtgtgcaatcatgtttgagggctagggacattttcccccaccagggcacgtttggcaatatctgggggcattttcggttgtcccaactgggggcgagggcatgtagtgggtcgaggccaggtattgctgctaaaactcctacagtgcgcaggacagccccccaaagaattatctggctccagatgtcaagaatgccaaggattagagaccctggcccacaccctcagtccttcagtgggatctgggaccagtagcactgacacagcctggaagcgtagaaatgcagaatcccaggccacaccccagacttgcagaatccaaaacaactccccccaccccccaccactccccccagaaaaacccggccgcatgtgtgcacattaaagcatgcgaagccctggtttcgaggacacctagggtcccttgccaactgatgagttcaaggttgggaggcactgagcaccgcggataagaatgtgggctttgagatgacacaggcgtcctgggcagacagataggtcgggaggggaggaggagagatctgcggcatttctgcccctgagagtctccttcctctccgtgggtctggagggagagtcaggcctcttcagctgccacactcacccaccttccctctcctttgtcccacaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctggtgtgtgtttaacgccgtttccctttgcatgcagggagggacttctacgtgtgggcagtgggccgagggagtgggtgttgatggtaatggcatgtagagctccctggcagttccggctgtggttcatattttattttccagcctgttaaccaattcctcagtattttgttcctttcctgaattgtcaggttgatgttctccttggtggcatggcgttttcattttctcttttccttgacagtgtcagtaattaactaccctacaatggacgacacatcatatttctccccttgaatcctcccaaacgctaaccagactcacttattcattagtccctaattatggtggtcaaaattctctcaattgcaagggatataaatctgtcttaaagtagcctaagtggccggttgcagaggctcacgcctgtaatcccagcactttgggaggccgaggcgggcagatcacctgagatcaggagttcgagaccagcctcaacgtggagaaaccccgtctctactaaaaatacaaaatgagctgggcgtggtggtgtatgcctgtaatgccagctacctgggaggctgagacaggagaattgcttgaacctggaaggcggaggttgcggtgagccgagattgggccattgcactccagcctgggcaacaagagtgaaactccaattccaaaaaaaaaaaaaagtagcctaagtaaatagagggaactttggggctgcatgtatctcagaaatctggggactagcttcaggtgtggattgatccaggagatcaagcaatgttgtcagtactcagtttcacccactgccctgttgtcctctgagttaacatcattctcagtggtacttccctacatggctccgtagctttgggctgataacatcctgatagataaaggtgccagagaaaagacaaggcagcatttctctgcacagccagagtcagtctcagagagcactctgattagcctggcttggtcctattcacacccgtgaaccaatcactgtggcccaggaggcagagttctctcattggccagcctgggtcacatgtcctctcccatggcagaagagatgtgattgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttagtagagacagtgtttgatcatgttggctaggctgatcttgaactcctggcctcaggtgatctaccctctgtggtctcccaaagtgttggaattacaggcgtgagccaccgtgcccagcccactccctgaaatagttttgttttgttttttttgcatgctcagtgtactgcctcctctttgaagggtaacatgttagctacttgcagacatatagcagctgacttttgtgtcttctgtgggtacaaccccagcagggcctgatgcataatgggcacagctcaaattattatctgttattgaaagagaagggctggacgaaatggctcatgcttgtgatctgaacactttgggaggccaaggcgggtggatcatctgaggccaggagagcagcctggccaacatggcaaaaccccgtctctactaaaaatataaacattagtcaggcatggtggtgtatgcctataatctcaactacttgggtggctgaggcaggagaatggcctgaatccgggaggcggaggttgtattgagctgagtttgtaccactgcataccagcttgggcaacagagcgagactctgtctcaaaaaaaagaaaaaggaagaagaaaaaattactggtttatttggctgtagtttggtttttttttgtacatttgtagagcagaaggtgagtaaagtgtttctaataataaaactcagaaaaaacaccagaatttaattgtctaataggctgggtacagatataggtggcatgcgcctgtaatccctgcactttgggaggctgaggtggaaggattgcttgaagccaggagtttgagaccagcctgggcaacatagtgagaccctgtctctacaaaaaaaaaaaaaaaaaaaaaaaattagctgggcatggtggtgcctacctgtggtcccagctaccgtggaggctgaggcaggaggattgcttgagcctaggagtgcagaggctgcagtaagctaggatcacaccactgcactcctacctgggtgacaaggcaagaccctgtctctagaagaaaaaaaaaatctaaataaagtgtcttttcaagcaggtgtcttggggagtccacttttgtaaaagtgctactatgggaaaaatatttttggaacatttgttctagaactgccttcaggattggtttatgaaccgttaagaaaattgtctaacatcacgttttgttttagatggtagttgcttgagctcagcactgttgacacttggggccagacagttctttgttgtgggggctgtcttttttttttgttcttgttattgttttttttgtttttttaagggacagagtcttgctctgttgcccaggctggagtgcagtggtgcgatcatagctcactgcagccttgaattcttggcctcaagcagtcttcccactttgtcatctcatctagctggggactacaggtgcacgccaccatgcctggctaagttatttatttttttgtagaaatgggggtcttgctgtgttgcccaggctggtctcgaacttctaccctcaagctatcttaccactttggcctcccaaagtgatgggattacaggtgtcagtcactgcacctggccacaaggctataagttaatacagcaaaattagcaaggaattaaggcacacatggggcggtgttcaagagaagccaggtgcaggcttccaggagtccccagcagagtcacaggttcactaattctctggcaaccatgatgattatgtgtgtgaaatgttgccaaccagggaagcttggtaggagctcagttcctgggtttgtattaggggcaggtcacataagcagcctttgcttggcacataccaaaagtctagactcccagagggaaagcggtgttcagcataaaccatattgtttgtacaaacagttgaggcacactgagctactctacccaattctgttaatggtggaaaccctgtaagtatgcagacactagccaagggctaaacttgtaagcagccttcaagcaggaaaagcaatcaggtggtcgtgttcacacttttctgcttactaccttattacctttctaaaaatctaagctgggtgtgatggctcgcgcctgtaatcccagctacttgggaggcagaggtgggaaagtcgcttgagcccatgagtttgagaccagcttaggcaacatagtgagaccttgtctctacaaaaaatcaaaaaaatagctgggcatggtggtgtgagtgtagtcacagctacttgggaggctgagttgggaggatcacttgagcccaggagatcgagagcagtttgagtaacatagtgagaccttgtccttacaaaaaaccaaaaaaattagctgggcatggtgatgtgactagtcacagctacttgggaggctgaattgggaggatcgctggagcccaggagttggagaccagcctgggcaatgtagcaagacctaatgcttacctgtagtcccagctactttggaggctgaagtaggaggatcactgatgcaaatagccactgtactgcagcctgggcaacatagcgagacctcatctcctaaaaaaaaaaaaattagaatcctgcagttgtaatttgcaaaactcatgtggccccaagggcttgggagaaaggagcgtggacctgcttattcttcaagggattgggaggacctggagagatgctcaggaatgaaaccacaggctcttaacaccctattgtggggtaaaagtaacacaccttgccctgaacttggtcagcagcatccacgtgggatggatcaaccggggaagctgttacgggccctgttttcttctgtctggtgagtgatgaagagtctcctttccttccttagaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggccttgctgtgttgcccaggctggtctcaaactcctgggcttaagtgatcctgttgcctcagcctctcaaagtgttgggattacaggtgtgagccatcatgcccggctttcagctttttatttttggagatattttgtattttaaaaagtttgaatacccaagtaatagagtgatgtttcttattataaaaaagtccaaatcaagccgggctcacccctgtaatttcagcattttgggaggccaaggtgggtggatcgcctgagcttaggagttcaagaccagcctgggaaacatggtgaaacctgtctctaccaaaaatggaaaagttagctgcatgtggtgatgcgtgcctgtagtcccagctacttgggaggctgaagcatgaggatcacctgaacccaggaggtcgaagctgtagtgagccatgattgtgccactgcacaacagagtgagaccctgtctcaaaaaaaaaaaaaaaaaaaaaaaaaaaaaaaaaaaaaaaagtttaaatcgtacaaaagtacataaattaaaaggggatacccccttccctactctctcaaccactgcaaatatatagaagcaaatccttctacaactttctacgtatgtatatacagacctgattaatggtatagtttggtttgtttttatatatgtgggtttttttttttgtttgtggagatggagtctcactttgttgcccaggctagagtgcagtcgtacgatcttggctcactgcaacctctgcctcccgggttcaagtagttctcctgcctcagcctcccgagcagctgggattacaggtgcccaccaccacacccagctaatctttgtatttttagtagagatgaggctttaccacattggccaggctggtcttgaactcctgacctcagatgatccacccgcctcggcctcccaaattgctgggattacaggcatgagccaccatgcctggccattatatatgttttgtgtgtgtgatattattaccatatctgtttttacctaaatgggcccacgtggcagcatgatttttgtcctttagcgccctgctttggggacctctctgtgctgtgccgtatagcttcaattcattcttccaacccggtgccttttggtctataatggagatggtgcagtttatttctttgctcttctgttgatggatatttatggtgtgctgtggaatttcaaatgggagcactaggctgcactgacgataccacagggagatgagtttcaggacatgggcctgttggaaggagaggcctcacgtggtagggttgggtgggatgggtgaggcaggggctttaggattgagtcacccttcagtctcttgatgtgtaggatgccctgagtggcccgactcaacccatttcagtccctggcctccagatcatgtagcttatattcttcccatctgtgacccggggatgactgtagcactaaatgataagagttcttgtgattgttaagtgtctgaatacatgtaaaatgcttagaaaagttgctgggatacacaaaatcctgggtggtagtaaaagtatttaacaactgcactgcacaagtatccactatttggaaccagtgctagccagtacagaaacatttcactattttaacaaccatgggccaggcacaggggctcatgtctgtaatcccagctctttgggagcctgaggcaggaggttggcttgtggccaggagtgcaagaccagcctgagcaacatagcaaggtgccatctctacaagaaatacaaaaatgaactgggtgtggtggcatatgcctgtggtcccagatactaaggaggctgaggtgggaggatcgcttgagcccaggaattcaaggctgcagtgagctatgatcatgccactgcactccagcctggatgccagagtgagatgatgtttccaaaaaaaaagaaaactgggctgacaagaaataagaaaacaggctgggtgcggtggctcacacctgtaatcccagcactctggtaggccgaggttggatcacttgaagtcaggagttcgaaaccagcctggccaacatggtgaagccccgtctctactaaaaatagaaaaattagccaggcgtggtggcaggcgtttatagtcccagctactcaggaggctgaggtaggagaatctctttaacccgggaggcagaggttgcagtgagccaagatcgtgctactgcactccagcctgggcaagagagcgagactccgtcacaaaaaaaaaaagaaaaaatacgaaaacagagaagaaaaacaccaccaccatgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaagatcacgccagtgcactccagcctgggcgacagagcaagaccttgtctcaaaaacaaacaaaaaagtcactatgtcagcaaggccttccctgaacacttggtttaaacatttgccatcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgcttaaaaaaaaaaaaaaaaaagaaagaaaaaaaaagctgggcatggtggtgcatgcctatattcccagctactcaggaggccgagacatgagaatcccttgaacctgggaggctgaggttgcagtgagccgagatcgagccacggcactccagcctgggcaacacagcaagaccctgtctcaaaaaagtaaaaaaaaaaaaaaataagtaaaataaaatgtacttattttattgtctgcttttcccccactaggatgtcagctccagatgggcatttttgtcgtttctcttgactgctgtatcctcagtatataaaacagtgcatagcaggtgctgaacaaatattgtcatccattgtaaaaaaaaaaaaatacagaaagatataaaatgaaaagtatattgtcctctcttccatcagttcctcccttctaaagtgacagtttcgtgtacgcttttagagaaaaatggacaagcatataggtatttaaaaatactttgacagatataaatggaatcatactgtacatagtgttctcttttctttggttaacaatatatagtcttggttcgttcattctggtctacttcattttagttttttggggggttttgttttgaaatggggtctcgctctgtcccccaggctggagtactgtggtgcgatcatagctcactgcagccttgaactcctgggcccaagcaatcctcctgctttagtttcctaagtagctgggactccaggtgcactgctaccactcccagcttgtttcatttgtgttcatgatggatgcttgtctgacgtgcagatgcgccctgctggaattaccctttctcccattccttgcaaaaacaggttgttccctgttttttttgctgttatgatccatgctacactgaaagttctggtacctgtcctggggtatggtaatgggtctatccctgcctagctggctttgaaaagtttaaagacaacagtgcaacttacaatttgcaaagttggccgcaaatcaggagaccatacagagatggactttggaaattccctttttaagcacagttaaaaacagttaatggtgaaggatgacttcagatcatgccccatgtttgttttttctttctgtctttttattaactgtgtcattctttttgtaatgttgtgctcattacaactattccttcttggtcaggttggcaaattatatgtttttctggcaagtttctgtgaagcagagttaaacatgtttatgaatatgaacttttctgttaaactaccatctgcttcatctttgttgagtttcaggtggaatgtctaaggaagctccagctgtttcagcatttgcgaaagcgtgttcatgctcccactgaattttcttagtcttgccttacttctctcagggtctggaactgcaggagagatggtgttcaaattcaagcctgcatcagaatcacctggagagcttgttattatattttattatttattcatttattgagatgaagtcccagtctgtcacccaggttggattgctatggcactatcttggctcactgcaatctctgcctcccgggttcaagcgattcttccacctcagcctctgagtagctgggattacaggcatgcagcaaccatgctcagctaatttttaaaatatctttagtgtagagatggtgtttcaccatgttggccaggctggtctcgaactcctgacctcaggagatctacccgccttggcctccgaaagtgctgggattacaggcatgagccacagtgctggctgttagcttgttactataaaactcagctttctgggccccacccaaattttcagttttagtaggtctggttggggcctgagtatttgctttcctaacatatccctaggtgctgctgcttctggttcaggttgacatgtagagacaccggagtggatcctcactgcctaaagtctggtccgtggaccagcagccatggcatcacctggtgcttgttaacggtgcagaatttcaggcctcagcccagatccactgaaacggaatctgagttgtaactagttctctaggtggtgtgtatgcacattaaatttcgagagagactggcagaaagtaggagtaaagaaactttttctgtaaatactttcggaattccgggccatacagtctctgtcacaaataccagtctcttccagcgtagtgcaaaaacagccttagataatatggaaatcgatgggtgtggctgtgttcctgtaaaaaagtatttagagacaccaaaatttgaattttatagaatttgcatgtgtcatgtaatattgttttgatttttttaacttttaaaaaatatgaaatctggctgggcgcaggggctcatgcctgtaatctcagcactttgggaggccgaggcgggcgggttgcttgaggctagcagattgagaccagcctagccaacgtggtgaaaccccgtctatactaaaaatacaaaaattagctggaagtggtggtgcgcacctgtggtcatagctactcgggaggctgaggcaggaggatcgcttcaacccaggaggcagaagttgcagtgagccaagatcatgccacacactcctggctgggcaacagagtgagaccctttcctgctgctgcccccccaccccctcccagccccccacaaaaaaaaattagccaggtgtggtggagcatgctggtcatccaagctttttgggaggctgaggtacgggaatcgtttgaacccgggaggcggagatcgcagcgagctgaggtcacgccactgcactctaagcctgggcaacagaacaagactctgtctcaaaaaaaataaaaaaaatgaaatcaatgctgagctcatgggccgtatgtaaacaggtgtgggccaaatgtggacctgagccatccttgttggccagcccctggcttagaggactggaatgttcttctgagaatcaggacacctgccacattctactgccagctcacagtgtgaccccaaagctggtcatctcacctcgctggctctagattttgtcacatggaaaatgaaggggttagattccaagcatgtcaaatactgggccctgtcctccttcctcatgcccacagcagacacccacagtcactcatggggttctttcccactgagttatgttcaagcagccctccaggtgactggtgccagtggcctagagttgagcaagaaatgacatcttgttgcccttctgtaactccatgttccctaagatcacttccagctccaatgcccctgcattctgccttgtacattgcattcttcttacactccaataccttgactttaccggggtgcgttgatgaactctctctttttttgttttttttgggactgagtctcactctgtcacccaggctgaagtgcagtggtgccatctcagctcactgcaacctccatctcccagttcaagcaattctcctgcctcagtcccccgactagctgggattacaaacatgcactaccatgccttgttaattttaatatttttagtagagatgggtttttgtcatgttcgccaggctggtctcgaactcctgacctcaagtgatctacctgccttgatctcccaacgtgctgggattacaagcgtgagccaccgcgcctggactctcctttttttttgagaaggagtcttgctctctcgccaggctggagtgcattggcacgatctcagctcactgcaatctctgcctcttgggttcaagcgattctcctgcctcagcctcctgagtagctgggattacaggcgcctactaccatgcccagctaagttttgtatttttagtagagacggggtttcaccagggttcaagcaattctcctgcctcagcgtccgagtagctgggagtacaggcgcacgccaccatgccaagccaattttttgtatttttagtagagatggggtttagccgtgttggccaggctggtctcaaactcctggcctctagtggtccacccacctcggcctcctaaagtgctgggattacaggtgtgagccgccatgcccggtgggtcttactttataaagtaggaagtaatgtatttgcatatggtgaaacataattaaagctgcaccagatggtattcatacagccggacttcgcacgtggccacctcagcctgctgacattcgccaacaggtcatcctttgtccctgtgttgtagggcctggactgcacattgcaggatgtttcccagcatctgtggcctctacctgccagatgctaagtcgtacctctccctcttcttcccagtggtgacaatagaaaatggctccaggcattgcgaagtgtccccttgggggacagaattctcccagttgagaaccacagtcaatagtgaaaggcccaagcccttcctcctaacaccagtcaccttgcttccctctctccatgtttcttgtgtgtttttccagagtccacgtctgtatcactgtaatggtggatacatgtcatacatgtagttatggttacttgattctgtttactttacttttatacaagtgatagtaagagtcatacataaatacatacaaaatggctttttttttctttttttctttttttttttttttttttgagatggggtctcacactgccgcccaagctggagtgcagtgacatgatcttggctcactgcaacctctgcctcccaggctcaagtaatcctccaacctcagcctcccaggcagctgggactacaagcatgcaccaccatgcccagctaatttctgtaattttgcagagacagggtctcactttgttgcccaggatgttttcaaactcctgagctcgagcagtccgcctgcctctgtctcccaaagtgctgggattgtaggtatgagccactgcacctggccttgatggcattttgaaaggtcttgtctcagaggaaaagatacaagccagagggcgctggtgatgaggtttggtctgtgccttgtgtcccgcttaggaggggatgggcagcgtgttctcacagctttttgctctgcacattggattcgttggcaaaacccacagtttccaggctgtcaccaaactttgcttatcacttcctgccctgttccccattaggaaaccacagcagaagatgcttaagagcaggactggcttttcttctcttttttctttctttctttcttttttaaagagacagggtcttgttttgctgtccaggctggagtacagtggcttgatcacagctcactgcaacctccaactcctgagctaaagcgatcctcctgcttcagcctctggagtagctgggattacagatgtgaaatactgagcccggctaccggctttacttaaccttttcttgagctttcttgccatttagtttcccggagtttccagagacagagtttgttgagctgtttggcaagaaacagatgggcctgggtgtcagctggggagaccttgtcctggccgaggcatcgaagcctctgactacattaggataaaatatgtggcctttagttcccctggaaggtgcctgagtgttttttccactggtgtgcattcctgtgcttcaaagacgatgaggtgtttacccagcggtaggtgtgatggaacacagaggccggggaaggccagggatgccatccagggactgatgggactgtttttctggaatggcaaacctggcatttaccacgtccacctaatgcactttcctaaaatagcatcgccaggcagccgtcaatatttaacattttctgtcttggatgatttgtgagcttcttgccttctgtttaccctgaatctccctttgttagaataattcatcattctctatggtaatgatctgtcctgtagttctctgctgatcatatcctagggcccatggagacactgccacgaccatgtcattttatttatttatatatttatacatttctgtatttttgagacggagtctcattctgccgcccaggctggagtgcagtggcacaatcacagctcactgcaacctccacctcccaggttcagctgattctcctgcctcagcctcccgaagagctgggattacaggtgtgcgccaccacacctggctaattttttgtctttttagtagagatggggtttcaccatgttggccaggctggtctcaaactcctgacctcaagtgatccgcccacctcggcctcccaaagtgctgggattgcaggtgtgagctaccatgcccagtcagaccttgtcattttgtgcttgtaccagcaaagcatagggaccttggcaaatagttcatgctctgtaaatgtatgtaggtaaatgaataaatacatgaatgaatgagaggttgaaataaatcatattaattaggaactgtcttgcaaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtcgatcacatgcttcttcctgagccagtcactgaggccagggagataggatgcttgggtcagccagggctaggtcatgtctttcagggcttggggccaaggtagggggtgagggaggaggttcatctgtggctgaagctcataggttgacactgggagaagttcagttcccccagagaaaattgcatgttgccataaacagagtaatagatgccaggtaggcaggaagagcaggtaactgcacacagggcatcaggatttttagggagtgggctggagtgtaggggttccattcattggttttccacgtttctcagaaaaggcacctaggggacaggtgctcctcactgtgtatgaagggcttttgcaccctagaccctcgcctattacaaggcgaactccagtctcctgctgcctggagccccagtcattgtgcccgtcctaccagcctcttcggatttccaaacactgcctgcagggaacctgttaaagcctgtgcttccactagactgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactcccacccatccattatctatccagcagacattcactgagcaccatgatctgggctctgtcctaggctctgacaatacagcagtgcatactacaggtaataatctccagtcatggaacattcatttttcacggagagaaacagacaaggaaaaataggcacaataaataaatcctagtgctagagaaagccatcctaagtgctatagaaagaaaagagtcagatctttggaataagggcggcttgcagttttaagtagggtggtccaagctcactgagaaggtgacacttgaggaaagacttgatggaggtaaagaggccaaccagggagtagcaagagcatgtgcaaaggccctggggcattactgtgcccattcataggtgggataaccatggaggctgaaacagtgggagtgaggggagagtgacagatgacgccaaatgaggtacagggaagggactttacaaatcagctgggccttgggatctgagtcagcactttgacttctacactgaaaaataggttgactttggagaggtacttttttaaaaattacttgtttagagatgggggcctcactctgttacccaggctggtgcgggggcacagtaatagctcactgcagcctcgacctcctgggctcaaatgattctcctgcctcagcctccctagtagctaggactacaggtgcatgccactatgcttgacttatttattaatattattgttgttttgagacggagtcttgctctgttgcacacgctggggtgcagtggtgcaatcttggctcactgcaacctccacctcccgggttaaagtgattctcctacttcagcctccctagtagctgggactacaggcacatgccaccacacccggctaatttttgtatttttagtagagacagggttttgccctgtcagacaggctggtcttgaactcctgacttcaggagatccacctgccttggcctcccaacatgctgggattacaggcatgagccattgagcccagccacctggcttattttttaaaaaattttgtagagacacagccttgcttttttgccctggctctgctcgaacttctggcctcaagtgatcctccctcctcggccttgcaaagcatttggattacaggcatgggctaccatgccgatcgaaatgtatttttttaacggaggtataattcaccatttaaaagtgtgcaattcagtggtttttttgtgtgatgtgtggtggtgtgaaggtcacccagtgggttttttgtataaatgataatgacaatcaccactaattccaggacgttttcattaccccaaaaggaagccctgtacctgttaccagttgctccccaaatcttccattccattccaggcaaccagtaatctgctttctgtctgtctctgtttatctactgtggacttttcatataaatggaatcaaacaacaggtggccttttctgactgttttctttttttttgagacgaagtgtctcccttgttgcccacctgaagcgcaatggcatgaccttgcctcactacaacgtttgcctcctaggttcaagcgattctcctgcctcagcctactgagtagctgggattataggcatgcaccaccactcctggctaattgtgtatttttagtagagacggagtttctccatgttggtcaggctggtctggaactcccgacctcaagtgatccgcccgcctcagcctcccgaagtgctgggatttcaggtgtgagccaccccgcctggccatctgactggtttcttagcatgatgttttcaaggtttatccatgttttagcatgtataagaatttcactcctttttatggttgagaagtctatcatgtagatacatgtagaccctttcgagtaaagaatatctctgggctgggcatggtggctcatacctgtaatcccagcattttgggaggccgaggcagacggatcacttgaggccaggagctcaagaccagcctgaccaacatggcgaaaccccatctctactaagaaaaatacaaaaagattagctgggcatggtggtgggcgcctataatcccagctacttggagactgaggcatgagaatcgtttgaccttgggaggcagaggttgcggtgaactgcgatcgcaccactgcactccatcttgtgcaaaagaatgagactgtgtctcaaaaaaaaaaaaagtatctttaggtaagatgccagtgttgcgttaccgcttagaagatgggagccaggatgggtgcagtggctcatgtctgtaatcccagcactttaggtggccgaggcaggcagatggcctgagcccaggtgttcgagaacagcctaggaagcatagggagaccctgtctctacaaaaataaaaaaactagccgggcatggtggtatgcgcctgtagtcctagctactcgggaggctgaggtgggaggaatgcttgagcccgggaggtcgaggctgtggtgagccatgattgcaccactgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttgggaggctgaggcgggtagatcacctgaggtcaagagttcgagaccagcctggccaacatagtgcaacctcatctctactaaaaatacaaaaattagccaggtgtggtggcgggtccctgtaatcccagctactcggaaggctgaggcaggagaattgcttgagcccaggaggaagaggttgcagtgagccaagatcgtgccattgcattccagtctgggtgacacagcaaaaactccgtctcaaaattaaaaaaaaaaaaaagaaaaaccccaaccttacggccgggcatgatggtacatgcctgtaatcccagcactttgggaggccaaggcaggtggatctcttaagcccaggagtttgagactagcctgggcaatatggtaaaaccctgtatgtaaaaaaaaataaaataaaataaaataaaaataaataaataaataaataaataaataaataaataaataaatatgtttgaaaattagccaggcatggtggtgtgcccctgtactcccagcgactcagaaggctggggtgggaggatcagctgagcttgggaagttgaggctgcagtgagtcatagtctcaccactacactccagcctgggtgaagggagtaagaccctgtttttttttgttttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccagctaatctggaggctgagacacgagaatcgcttgaacctgggaggtggaggttgccgaggttgcagtgagccgagattgtgccactgcactccagcctgggcgactgagtgagactcagtctccaagaaaggaaataatacaacatgaaccccgtgtacacatcactcagattcaacatcggcattttttggctgggcgcagtggctcacgcctgtaatcccagcactgtgggaggctgaggtggtaggattgcttcagcccaggagttcaaaatcagcctgggcaatgagacccttaatctacaaaaaataacaaaatgggtgtggggtgcatgcctgcagtgactacatgggaggctgaggcagaaggatcgcttgagcctaggagtttgaggctgcagtgagttatgtttgcaccactgcactccagcctgggcaacagagcaagactctgtctcaaataaagaaaccaaggttgggcgcagtggctcatgcctgtaatcccagcactctgggaggccgaggtgggcggatcatgaggtcaggagatggagaccatcctggctaacacggtgaaaccctgtctctgctaaaaatataaaaaaattagccaggtgtggtggcaggtgcctgtagtcccagctactcggttggctgaggcaggagaatgttgtgaacccgggaggtggagcttgcagtgagccgagattgcgccactgcactccagcctgggtgacagagcgagactccatctcaaaaacgaacaaaaaaacccaaaacattttgccacagttgatttatctcattctttttcagtatccctcccttgtccctctttcccttcatttgtttttaatgctaaactctgctatctatcccttcattctttcctttctttgccgaataattttaaagcaaatctcagaccccttacattctacccacaaatatttcagcatgcatttcttcctacataatgtaataccatcatcatgtctaagcaaactaacaataagtttttacaataatactcagcccatatccaagttttctggaatatctcagaaatgcctgtcccattgggctgtttgaattggctctgttgcatttgctgttacgtttccagagtcccttttccaccaggcctctgcccttttcttcttttatttttatttttatttatttattttttgaaatggagcctcactctgtcacccaggctggagtgcagtggcatgatcttggctcactgcgacctctgccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctggagtgcagtggtgcagtcacagctgtcactgcagccttgatttcgtgggctcaggtgatcctctgaccttagcctcccaagtagctagaactacaggcacacacagcaccatacttggataatattttggtatgttttgtagagacagggtttcaccatgttgtccaggccggtctcgaactccttagctcaagcaatccacctgcctcagcctcccaaagtgctgggcttataggcatgagccagttctcctggcctttttttttttttcaatattaaattgttttatttggagagacaaggtcttgctttgttcctcaagttggtcttgagctcctgggctcaaggatccctctgcctcagcctcccaaagtgctgggatgacagatgtgagccactgcacctggccatgcatttttattggcaggtttgtttgttttgtagcttgttaatttatcgtttcccagcccatccccctgagccagggatgttgtttgtaaccatctctctaggcacttaataataaatattaggccgggcacagtggctcacgcctgtaatcccagcactttggggagctgaggcaggtggatcacttgaggtcaggagttcgagatcagcctggccaacaaggtgaaaccccgtctctactgaaaatacaaaaattagctggacatggtgttgggcacctgtaatcccaactactcgggaggctgaggcaggagaatcacttgaacccaggaggcggaggttgcagtgagccaagatcgcgccactgcactccagccagggcaaagagtgagacttcatctcaaaaaaaaaaaaaaaaataataataataaatattaatggcactaagtgcagtgacacgttcacttataaagcctctgtcatgcacatgccattccaaggatgtcaatgtcccaacttgtccattactcaccatggtacccctggaggagggtgatggaaacccccattttccagatgaagaaactggtctctgaaacttgcctgagattgcacagctgatcaaaagaagaaccagcattcacacccacagcccatcggtagagtccatgctcttcctggccatagggtgttgcctcactgagatttactgagcacctactatgtgccaagcattgtgagaagtgctctgtgtgcactgcctcatagacaccccatcacagccctctgaagttgattgcatgattgtcagccttattttacagatgaaaaagtgaggcacaggctgggtgcagtggctcctacctataatcctagtactttgggaggccaaggctggaggattgcttgaggccaggagtttgagaccaccttgggtaatgtagtgagacctcgtctctacaaaaattaaattcaccaggcatggtggtgcacctgtagtcctagttacttgagaggctgaggcaggaggattggctgagcccgggagttcaaggctatagtgagctatgatcatgccactgtactccagcctgggtgtcagagtgagaccctgtctcaaaaaacaaacaaacaaaggcacagagaagttaactaacttgcctgtggctacccaggtacgaagtggtagccccaggattcaaacccatacagtctggctccagagtccaatgtcagaagattgaatgtgtgtaaacgtcggttataccgcgtgagctgtgtctggcacctcgcaggcgctcaggtatctttagtggcacctaaaacgtttgacacgtttgacacagcacctggtgcatagaagatgataaacagatcctgggagttgtcacttctctggtctgagcgagatggtctcagcatcttcagctcagccccctggtgtggggttttttatcctgggcgctactgacatctggagacacattgttctttgtggttggggactgtcctgtgcactgtgggatgttgagcagcaaccctggactctacccattagatacagtagtatccatcccaattttggcaaccaaaaatggctccagacattgccagatgtgccttgagggacacagttacctccagttgagaaccgtggcccaagtggatgctggactcttcctcccaacactcctgggctgtggtcatctggtttctgctgtcccagtgtcccacatcccctcacatcataaggcaatgattccatctactctggggtcaaatttctctgctaaccacaggctgaaatttgaggtggccggcggtgggtggggggtggtttcttggtactgaagttgttcacagctcaatgcaagcatcaggaaacccctaggcccctgggtgccgcccgcaccccagcccctccttcctgccctaatagtggcctcctaggtggttggacttcctggaatgtttagcacgctctagccagtgggggcccccttggctgctcccagctcccaagctaaccgttctctgcaacctctctgtctccagtggcttttcttaaattccttaaatagcaactcccagtttcctcattccacgtccactcgtagaagagctgagggagaaagttaatctaggttaaccagcaccttcctctctctctaggttttttgtttttttgatgcatggaggaagttatttcttcatttgacaacttaaacaaaaaatactcctgtattatctccagatggtcttaaggtggctcataattcagagagctgcttttctgttttttctttttctttttttttttttttttgagacagagtttcactctgttgcccaggctggagtgcaatggcacgatcttggctctctgcgacctctgccttggtttcaagcgattctcatgtctcagactcccgagtagctgggactacaggcatgcgctaccacacctggctaatgtttgtatttttagtagagatggggtttcaccacgttggccaggctggtctcgaactcctgacatcaggtgatctgcccgcctcggtctcccgaagtgttgggattacaggcatgagcccctgcgactggcctgcttttgttttaagtgagagacatgaagtaaaaggaaaataacaggaagaagagtaaaagaagacagaggtgctaggagctttagaagtgtggagctggccgggcatggtgtctcatgcctgtaatcccggcactttggaaggccgaggcaagcagatcacttgaggccaagagttcgagaccaggctgagcaacatgtcaagaccccacctctacaaaaaatacaaaaaaaaaattagctgggtgtgatggtgcacatcctgtagtcccagttgctcaggaggctgaagtgggagaatcgcctgcgcctgggagatggaggttgcagtaggccgagatcgcaccactgcgctccagcctgggtgcagaagccagatcctgtctcaggagaagacagaaacatggaaccagttaacgtgggctttgtctccgacactctccccttccctgtgccctcgtaccacacttcctgttccgtatcctctttttttgagtttatcgtgatggatgttttagaaagatccacctgctgtgatgtgctgtgtgtagagtggtgtggctgggggaggaagacagaggacctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttaggagaactgcctgcttcttattgacccagattgggtcctgtgccctctgtgaggcaatcgctatgccttcagacactgagtgtgctgattggccagtctcagtcaggggctgtgatgctgctgaactccagtgcccctcagctgcccagctcaccctttcttgccagctttctatctggcaccccacaccctacagtccttacctttccaaagcacatgatgtctaggaaattgaccttatccccaggcaacttgtcaagcacctctcattttgttctgaccagaggccttgatcaacagctttttaggcccccttaaggaatccgcaaaacacaggggtgatgggacccttttagaggtttagctcatgcctgggtagccaaatcactgctgtattttatgatgaaggagagaaactctccagagaaaacaatctgtagaaggcctgcattgaaaattcatgggggtactgcatgcttaggaagttcttccttatgtctaacttaaatcctgcctgcttcaattgtagctgttctgtcttgttgagctgcacaactaatctgtatctgtgtccctttcctgacccagtggttttcctgttcagttaccttccccccatgagcccccagaacctttctctaacccttttctctcatcagcctgtaagaatatttcagtctcacgtggacagtggcaggtactgtctcacgtggacagtggcaggtattgtctcactgggcttcctgcccactcaggccccataatcctttcccctcccagcacaggaacaaaaagcctgatgagtgtcaccatgcagcagtgtcataagaatgaaacaatcagtgacagcaacgactatcagcatttccactaatactctgaaatcagaaaggtggcagttaaaaagcacagaatcccagcactttgggaggccaaggtgggcacatcacctgaagtccgaagtctgagaccagcttggccaacatggtgaaaccctgtcactactaaaaataaaaaaactagctgggcatggtggtgcatgcctgtaatcccagcactttgggaggctgaggcgggcagatcactggaggtcagcagttcgagaccagcctggccaatgtggggaaaccccatctgtactaaaaatacaaaaattagctggatgtggtggcgctcgcctgtaatcccagctacttgggaggctgaggcacaagaatcatttgaacctgggaggcacaggtttcagtgagccaagattgagccactgtactccagcctgggccacagagtgagactcttgtctcaaaaaaataaataaatacttaagtaactaaatacagataaataaaaaataaaagcacattccatataagtgagtccagcaaaggtttggatgtgccctcccttccctgggaggatggaaaccctgctctggaggtgccgtcggcagtgggagtggcctggggttgacctgccccattgacagccggtcttactgggtgaatgctgagcttattttattttgctttctgctgttcgttaaaggatgatttcaatagagacatcttcctgaaattcaactcagatttattcatatgcgtttcccttttcaaccctttggtggctcccggctggcagagttcaggtgtcttagcacagcgtccttccagggcatatttcaaggtgctcccaggtctggccactacctacctcagtgccatcgcatccctggttacaccctgtgccttcacccctttacacctttctccggctctccacatgtttctgtgtgtgggacactcctgctttttgtcagagttttttggtttatttattttctgagacagagtctcacgctcttgcccagatcggagtgcagtggcacgatctcagctcactgtaacctccgcctcttgggttcaagtgattcttgtgcctcagcctcctcagtagctgggaccacaggccctgccaccaccacgcctggctaatttttatatttttagtagaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtccgcacctctttagtgtctgtgcaactgcacatttgtctcttggaatctgcctttgggaatgtcaagtttatgacgttgtttgttgttgtgggttttgagacagagttttttttgttgcccaggctggagtgcagtcgtgtgatcttgactcactgcaacctctgcctcctgggttcaaccgattcttctgtctcagcctcttgagtagctgggattataggcacccaccattactgcacccggctaatttttgtattttcagtaaagacgggattttaccatgttgacctgggtagtctagaactcctaacctcaggtgatctccccatctcggcttcccaaagtgctgggattacaggcgtgagccaccgctcctggcctagttaatgacattgtttttatttcagagcaaaaccctttctttgattatacagtgcctttagaaagtatacattgtggttgggtccaaattaatgacctttagctgttgttttaagaaatgttttatcattactttcaagttcctgccataaaataagatgaatgaaccatgagagctagattaatggaagaaaattccaaatcccgatgggatccacattgctttctgtttccttaaccccagctttctgctatcctggcactattagcatttcaggccagatgattatttattattggttgtttggcctaggtaaggggagtgctagaaatgtatataaaatatttatcttttcccaaatgttttagttggtgtggtttgtgtatattatgtctgaaatttctgtgggttctatggtaaggcaccactgttgacattttggctttttaaaagttaggatattcaagtcagcaggttaattatttgagaatttagagtaagaatgagggtacctgggacctgctgtcagctttgccctctctagaattcccttattcaagaatcttctggctgggcgcggtggctcacatctgtaatcccagcactttgggaggctgaggcaggttgatcacctgaggtcaggagtttgagaccagcctgaccagcatggcgaaaccccgtctctactgaaaatacaaaaattagtgggcctggtggtgtgtgcctttagtcccagctactcaggaggctgaggaaggagaatcccttgagcccggaggcagagactgcagtgagctgagatcttgacactgtattccagcctgagcgacagcaaggcttcgtttcaaaaaaaaatcttcaggggctccccttgcccctctgataaagcccatgctccccaccaagtataggcccccttgctgtccctggtgtgttttctgccagtcgttccctcacaggattgatcgatgttcctgtcacgctggcctttctgttccttgaatgtgccaagtacttttcacttccaggccttcgcatgtgctgttccctcggacttgaatgctcttccctcttctcctcatgaaactgactcattcttcactttttggttcttgtctaaacatatgtttgagctgagcatgatggctcatgcctataatcccagcacttcaggaggccaaggcaggaggattgcttgaggccaggagtttgagaccaggcttagcaacatggcaagattttgtttctacaaacgtaataaatatatagagaattaactacctcagcattttcattagcaaaatacacaaaacaaatatccttactctagcctttattctcatgctgtttgtgatacctgacatatggaaataaaaataagcctttgaaatggatgcttgatataggagtctttgcttcaatttttagcaaggatatttcctcaaagatccttcccggatgtcccaaactaggtcagtcttttaatttttttgagacaggatcttgctctgtggtccaggctggagtgcagtggcacggtgcaatctcagctcgtggtacctccatttcctgggctcaggtgatcctcccacctcagcctcccaagtagctgggactacagatgcacagcgccatgcctggctaatttttctattttttttagagatgggatttctctatgttgtccaggctggctttgaactcctgacctcaagcagtctgcctgccttggcctcccaaagtgctgggattacaggcatgagccactgcgcctagtcaagttagactcttaaaaagtgtcatatatctttttatctttgcgtccaccgtaactgtaatcaagtagttttccgtcacctgagggacttccactctttggaagcaggggttttgatcaccgctgtaggcattgagttaatagctagctactaagtaaataactgtaatcttatcaacgaggatatcaactctttgactcctgatattggagtcagtgattcacctgctgtgggttctgatcccagccctggcatctgttgtcctttgtgagtcagtttccctcttgccaaagcaatagttgtgatgaaaatgacttgtgaagtgaggccctcctagcaggcgggtgggccagctgttgtctcgttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctggcctcagcctctcaaagttcttttttttttttgaaatggagtctctctctgtcgcccaggctagagtgtagtggctcactcttggctcattgcaacctctgcctcctgagttcaagtgattctcctccctcagcctcttgaatagctgggactacaggcccctgccaccacgcacagctaatttttgtatttttattcgaggcagggtttcaccatgttggccaggttggtgtctaactcctgacctcaagtgatcggctggcctcagcctctcaaagttctttttttttttttgaaatggagtctctctctgtcgcccaggctagagtgtagtggctcactcttggttcaacctctgcctcctgagttcaagtgattctcctccctcagcctcttgaatagctgggactacaggcccctgccaccacgcacagctaatttctgtatttttagtagagatgggatttcgctgtgttggccatgctgatcttgaactcctggcctcaggtgatctgcccgcctctgcctctcacaatgctgggattacagatgttaaccacctcgcccggcctataacttgagtattttctgtatgttgggaactatgctaaacattttacacgtaattcttccccacagcaagcccatgggtggaatttgttgttatacctaggtaatcattgaggaaaaaggaggcacagagaggccaagtgacttacctgaggccacacagccacagagctgcagagagcatggttcctgtgtccatgttgttacctgctcattttgtcatctctaaaagggccattctctgcctctcaccactgcagaccctccctcctgctgtgctccatctcccaggttttcctgctgcttcacagcaacccccagcccctgcccacctccacaccttggtctgagccttcaaggcctggggtgcctcccctgctgcttgcctggccactttgctctggcaccccatggtggtcgtctggtgtgtcccctcttggaagaccaagagtgcaaagcactggcccatttctgtttttagttacaagccaggggctctgtcggctttcttacgtggtgaatgatgtttaaaaattgagataagcctgcagctccttggaaataaaaaacgaattattggctgggcgcggtagctcacgcctataatcccagcactttgggagaccaaggtgggaggattgtctgaggtcaggagttcgagaccagcctgggcaacatggtgaaaacccacctctactaaaaatacaaaaagttgccaggcatggtgccgtgcacctgtggtcccagccacttagggggctgaggtgagaggattgcttgaacctgggaagcggagattacagtgagctgagattgtgccactgcactccagcctgggcgacagagtgagattctgtctccaaaaacaaaaagaaggcacgtggctgccaggaccccacctcagtgcatgggagtcagggcaggcatctcaggagggactgggcagtaacctgtgatttccagccaaatagggaaacgacgttggcttatctgtcatggtgggagctggcgctgctgctggtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcagtaacaataatatgaccacgtccaccagcgccttccatgagactaagggatcacggccttcccactggtcaacatgatttggtgccgtcagccatcctttgctgagcacttgctgtgcaccacgtgccctgctcagcacctcacgggagattcaggttttctcttttgcccagttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctccccctgattttatttttttgaggtggagtttcgctactgttgcccaggctggagtgcagtggcatgatctcagctcactgcaacctccgcatctcgggttcaagcacttctcctgctttggcctcccaagtagctgggattacaggtgcccaccaccacgcctggctaattttttttatttttagtagaatcgaggtttcaccatgttggtcaggctggtctcgaactcctgacctcaagtgatctgcccgcctgggtctcctgcaatgctgggattacaggcgtgagccaccacacccggctgtttctgctgattttaaaactaacacatccccatggggggcatatagattaagaaaaacatgaaaaagaaaaatggaagcagttacacacattccactggttagaggttttgtatttttttcaagtctttttgctctgtgtataaactttttaaatagggttatcttgttccacgtatatatacaggaaacatcgtgctacatgacctcttgtaatcgttcccatacataccactaacattctgtgtaaacatattttaaaatagtacaaaacatttttgaaaattactaagtaatacatgcccattgtaacaaaattgaaaagtacaagaatatggatatcttcttataatatatgtgtgtatgcgtgtgtgtgtgtgtgtgtgtgtgtgtgcatgtatataaagtaaataaagctgggcacggtgagtaatcccaacacttttggaggcctagaccagtggatcacctgaggtcaggagttcgagaccagcctggccaacatggtgaaaccccatctctactaaaaatacaaaaatcagccgagtgtggtgatgcatggctgtaatcccagctactcgggaagctgaggccggagaatgtcttgaacccgggacgtggaggttgcagtgagctgagattgcgccactgcactctagcctgggtaacagagcgagactccgtctcagaaaatatatctaaataaagtaaataaaatagtccctcttcatcctgcatccctaatctttaattcttctcttagagagcaagggttagcaaatctggcccactgcctgctttttatatggctcttgagctaagaatgatgtgtgtatttttaaatagaagaaatctaaacaggaagaatattttatgacatttgaaaatcgtattaaatttagatatcagtgtccataaataaaactttattggaacatggccaatgtattttttttctttttttttctgcagacagggttttcctctgttgtccaggctggagtgcagtgccacagtcatggcatggtagcctccagctcctcggctgaatcaatcctcctgccttctgagtagctcctgggaccacaggcatgcagcaccatgcctggctaatttatttttatttttattttgtggagacaggtctcactatgtttcccaggctggtttcaaactcttggcctcaaggaatcctcccgttttggcctcccaaagtgctgggattacaggtgtgagccaccgcacgtgtcctgttctttaaagcatcgtctacagctgcttcaactcggcagggctgagttggtgccatggcaactgtaagatccataaagctgaaaagattgaccgttagctgtttaaggaaacatatgctgacttctattaatagtttgatgaatgtcttcccaaactttcagatttgcagataaaatgtatgcatgtgcatattttgtagtggttttgggggtggctgacagcgggagttgttttagaaaaaaattaagccagagctgggcacggtagcgcatgcctgtagtcccagcacttttgtaagccaagggcgaatggatcgcttcagttcaggagttcaagatgagcctggacaacatgatgagacccctgtcttgacaaaaaatacaaaaattatctgggcatggtggcacgtatctgtagtcccagctacttgggaggctgaggcaggagaatcgcttgaacccaggaagcataggttgtggtgagccgaggtcgcaccactgcactccagcctgggcgacagagcgagaccctatctcaaaaagaaaaaaaaaaaagaagaaaaaaattaagccattgggctgggcgcagcggctcacacctgtaatcctaaaactttgggaggccaagataggcagattgcctgaggtcaggagtttgagaccagcctgggcaacatggtgaaacgccatctctactaaaatacaacaacaaaaaaatcagccaggtgtggtggcgggcgcatgtaatcccagctacgcgggagggaggctgaggcacgggaattgcttgaacccgggaggcggaggttgcagtgagccgagactgtgccactgcactccagcctggacaacaaagtgaaactctgtctcaaaaaaaaaaaaaaaagccattgcatacaaactgttttgctgtggcaccatccttttattcctttacacacttgtatggttccctccctacctcttgtcattcaggtttttgttaaaaaataaccttccccattacctttgttaaaattgcaaaacccgcacacttggtacacccgttcccctttttgctgtgtttttgccattcagcaagcactattctactagtgttcgtttctcctgcggccctggaatctggggcaggggtctttgtttccttccccttccccagcttttagctcagcacctgaggcgtggcaggccctttgcacatgcatgttacaggaccgtgtgcacaggttcagctgctcctggatgctgttatcgcgggtgcatgtcccaccttcagacctgagttttgcccaccaggtgttcgtcggctcattcctcctttagtcttcactctgccaagctaggcagtctcacacatgtgcactcacgtggccgggtgtcccctttgcccacagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggtaggggcagccccagggttccacccactcagggtgtctggcaccttgaagggccacattggcctctttgaggttgccaccagccacttggggaaggcggctcctcagggcatgagggtgggagctggatggagccccctaaagaagcaatgtggaaaaccaccttagtccctgcagtgctgaactgggagagagtctcggtgctttatggccaggggatgggagcaccaggcttcagctcagctgacctcagggcagggtctagcgccttcctggaacatgaccttggacctgatgagtttcagggtccttatggcaaaaatgggaatgatggtaattaaagtcctggctctcggggctgagagaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcctggccaacatactgaaaccccaactctacaaaaaaaaaaaaaaaaaaattcagatgctattaagtgctttggaggggaaacaaaaaagacaatgccatgggctgaggagtgatgggtgtcattgtggcaactcaggcaggggatagggaaaccctctctggggaggttgcattggcatgggaaggagccagcagggagaagatctgggaagtgttgtgggcagagggaacagccagtacaaaggcctcaggaccagcatgagctcaatttgtttacaaaacaaaaagggtggtgtggccagaccatggtgtgccaggacgtggggggcaggagaagaggtcagcacagtgattgtcctgcagggccttccaggtgggttttggtctaactgccctgggaagccactgagtgtcagagaggcaaagtgaccagccccaggatacacagcagctgctggcagggttggttctcaagttggtctctgagtttctcatcctttgcctggggtgggagctccttctctgcagaggtcctagtgatctctaataagtgctttcttgagatgtaattcacacacgtaggctgggcgcagtggctcacgcctgtaatcccagcactgtgggaggctgacacaggtggatcacctgaggtcaggagttggagaccagcctggccaacatgatgaaaccctgtctctactaaaaatacaaaaattatcctggcgtggtggcgcacgcctataggcccagctactggggaggctgaggcaggagaatagtttgaaccttggaggcggaggttgcagtgaaccgagatcgtgccactacactccagcttgggcaacagagcaagacttcgtctcagaaaaacaaaacaaaacaaaacaaaaattcatacaacatacaattaacccacttaaatcacaaaatccaaccatcaccacagtcaggtttagaactttttttaatcacccccaaaagaaaccccaatccatcagccatgactccctattttccccagcacctccgaagccctaggcaaccactaatctttctgtctctctagatttgcttattctggacatttcatataaatgccatcacaataggtggaatgttgtgactggcggcttttacacttagcgtggtgttttcaaggttcgtctatgttgtagcttcatttccttttattgcggaataatatgccattgtgcagatagaccatactgtgttgatctgttcactggttgatggacattcaggttttttccactttctgactcttgtgaatactgctgtcatgagccctggtggttttaaaggaaaagttggtggccgggtgtggtggtttgtgcctgtaatcccaccactttgggaggccaaggcgggtggatcacttgaggttaggagttcaagaccagcctgggcagcatggtgaaacctcgtctctactgaaagtacaaacattagctgggatggtggtgcacacctgtagtcccggctattcgggaggctgaggtgggggaatcgcttgagcctgggagtcaggctgctgtgagccaaaatcatgccactgcactccatctggcctgggtgacagagcaagaccatgtctcaaaatacagttggatttttgtttcttgccagtgcatgatagctgacattcccttcagcttttaaattatttgattagactgaatttctgcatgttcattcccttgtggttgggaagttctaccttgagtctagcctgtttcttcttgctgcagaatccccctttgtctatctctcagcccgagcaatgcattgtggcaacttctcggtgactttttcactgacctgcttggcaggctacttttaggtgacaataccctttgtgctctctaaatcaaaatgtgtgggtttagctgaatcttttgcccagcgtgaggtctgtctctctacccttccgtccaggtgagcaaaaaatgtccttaaactctcttggccccagataggttccgcacccccgcctttctttcccagctgctagagtatccaagcagtgtatacagaacatggaaggctgccagatgctttgtgatttttgtacacatcagcacttaatttggtgatgcaaatgccgcccaccaccctggcacctcgtgcgttcattttcccagtttgacctccctacctcctgcctttgaggttacatagaagtccttggcagtgggtcttacatcaaactggggcacccccctctctcaccacccacccttttccattgctctggaggggccctggctataaagtcttgacatcagggtctggtcttgcccagccttagccaactcgaagcgccaatgaccttgggtttgtttaaaccacatttttggctcttcctaaaggggaacttttttccttgttggattaatcagctcttttttttagaacacccaggctgaaggggtgcaggtgttggtatttggtttgggagaatccttgaggggggatgggcaggaaccaggcttgtgaatggggccataccgacctctctcccgggatattcagtttactgatttctaagaaatatatcttttttactgtttgtctccctctctccttttttttttttttttttttttaacttttaatggcattccttttattcctaatttattcccatgccataagcttttgtttcttcaatttcttctgggatatatttttcttctgtgcagcctccccttccggtttaggaacagtttgttccctttcaggcaggatcatctggatgtggcagagtgagctcacgtatgggttaatccgaccgaccctgagctctgtaggtccggcgacgcaacttaggtgctttcttcagttggatatgctcaaggaccagagaatctgcatctgaacccttaagttcagtgtgactctctgtatttttaagcatgtgcagcagaaattcagtgctctttttgggccgccgaccttgtggccagccccacttcttggcctgggtacatctaccaactccaccattataatgtcagaatggtacatgttgtttctgtaaagtggcatctttctgatactttgtggccttttgtacgtgcatacctttgatggcctgggcgctttcaggagtgttctttttctttttcttttttttgagacggagtcttgctctgtcgcccaggctggagtgcagtggcgcgatcttggctccctgcaagctctgccgcccaggttcacgccattctcctgcctcagcctcccgagtagctgggactacaggcgcccgccaccatgcccagctaattttttttgtatttttagtagaaacggggtttcaccgtgttagtcaggatggtctcgatctcttgacgtcatgatccgcccgcctcggcctcccaaagtgctgggattacaggcgtgagccactgcgcctggccttttttttttttttttttttttgatacagagtctcacttgttgcccaggctggagtgtagtggcacgatcttggctcactgcagcctccacctcccgggttcaagaaattcttgtgcctcagcctctcgagtagctggagttacaggcatgtgccaccacgcccagctaatttttgtatttttagtagagatggggtttcaccatgctgaccaggctggtctcaaactcctggcctcaagggatcctcctgcctcagcctcccaaagtgttgggataacaggcatgagccaccatgcccggcctcacaaatgttcttaaggtgaacacgaagatttgaacctcttgatctgcatgattctgtggtgttttctggataaagtgaatagtgaaccattttcacagattgcctcaagccccttaggggaacaaatttttaagggatttaaaaaaatggctcattaaccttcatacctggaaggtaaaacacatcttcatgactctggtttctttcttaggaacctaatacctagagcagtggttttccatcaggggcaaattgcccccaccctggggacagttggcaatgtttggagacatgttgggatgtcaaaactggagtggggtttgcccctggcaggcaagcagggtagaggccagcgatgtcgctaaacatcctacagcactcaagacgaattcccccttaccctgccccccgtgacagggaatccccttgccaggacatccaaagcaccacgagcaagaaaccctgtgtgctccgacttcacactgctgaattcttcccttgtcctcttgggagaaggatctttattccaacaatgtggccatttttctcttttaaaaaattttatttatatatttttatgtttttttatggagatgggatatcagtctgttgcccaggctggtctcgaactcctgggctcaagcgatcctcccaccttgacctcccaaaatgcaaatgctgggattataagcatgagtcgcggcacctggcccgtggccatttttcaaaaccttgcttgaaccatctgttaacctcatggcaaatatttttccctcttaagtatttaccgagtttttcttaatgattataaaagcaacatgtgctcatcgtagacatttgcaaactacaaaagagtacaaagaatcaggaaaaaaggtggctcatatgtgtaatgccaggactttgggaggccaaggtaggcggatcacctgagggcaggagttcgagaccagcctcgccaacatggtgaaaccccatctctactaaaaatacagaaatgtcaggaggctgaggcaggagaatagcgtgaatccggggggcagagcttgcagtgagccaagattgtgccactgcactctagcctgggtaacagagcgagactgtctcaaaaaaaaaacaaaaaaacaaaaaaaaactcccgagaaagaacatctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaaaatgaggcgttgactataaagctgtgagttgaattcttccctccggggaggctggcctgctggaccttgcccaagcagagttccagaaccttcttgagtaaaggcagtgttggtggaataaacagtgagaggactggcaacggaatacacagacccggggcagcacttaacgtacgtgggtcaagggtagaaacagcacctggcttgacagcatccaaaacccaacacctggtggttgcatgaactcagtgacagtcactgaattacaagtttcgtgtgtttgctttaaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctcacgctgttgcccaggctggagtgcaatggtgcaatctcggctcactgcaacctccacctcctgggtccaagtgattctcctgccgcaacctcccaagtagctgggattacggatgcctgccaccacgcccggctaatttttgtatttttagtagagacggcgttgtgccacattggtcaggctggtcttgaactccggacctcaagtgatccacccgcctcagcctcccaaagtgctgggattacaggcatgagccatcgtgcccggctgctctgagggctttttggttgtctctccatccccaggactaagaaaagagcctgacacatagtagacactcagtaaatgtgttaaatgagtggatgaatcgcaccttggctgttcaaggcatgtcctgcataagcagtgggtaggccggagggctttggatgtttacactgcagataaatacctcagactaggagaaaataggagtggatttcaccccctctcaggtctgctttagaaagcagctttgtcagtcctgcctatgagaggggcccctctggcattgggaagtcagctctgcttcttgacttgactatacacttgtcagtctgcccatctgtctgtcgggtgtgtacagagtgcctgctgtgtgccacaaggccacctggtacgtgagcctctgtgtggaatggtgccccccacgttgagttgtgcagtgtgcatcttgtgtaactgcacttggccacctgctgtgccaggtgctggtgatacagtaatggatatgacccacttcatgcccttgagagctcacagtctgatgggagagacaaacgccaaacaattaagggtatcatagtgctaaatgcagtgatggagggctgcttgagggcctgggaaatcacagagaaggagcccccatcccagcctgggagggtccagggtgatatctgggctaagtcaccttttcttctcctcttgggcacatgtgcatctggctctgtgtggggccagcccctctcaggagcagtgtctgtcctcaaaggggctggagctgatgcccatgccacctcccagtgtcatgcctggcctgcctactgtaatactttatttcttttcctctcctgcgtaaaaacaagcctgaagactgaaggttggtctgcattatttgtttagctctatttatggttaaacacagttatgactttggccaggcatggtggctcacgcctgtaatcctagcactttgggaggccaaggcaggtgtatcagctgaggtcaggagtttgagaccagcctggccaacatggcaaaaccccgtctctactaaaaatacgaaaattagccaggtgtggtggcgggcacctgtaatcccagctatttgggaggctgaggctggagaattgcttgaacctgggtggcggaggttgcggtgagctaagatcacgccacttccctccagcctgggctaaagagtgaaactctgtcacaaacaaacaaacaaaaacccaacacagttatgactttggagaaaggggttggtcttgtgcagtgtgcttgtcccggatccacccagcacgtgtgggatggggaaactgacgcacaaatggagcagacccttcagccattcttgcctctccccctttagaaaagacactcccttcactcctttatttagataggggcttagggcgggagtttcgctttgcttcttaacaatatcttgggtcttctgaattcccaggcagcacagtgatggacgaggaggaagcaggtcagtactgcccgggttggagttggcttggctcatagaatgaggccagagacgggccgagactgtcgctgcatgtctggggaggtgccgtcagatgtctgtgttttcacccctccggttgttcattggttcatttagcacacatttactgggtacctactgtgtgtctggctttgaggctggcactgggggatacagcctgagtccccagatccctttattgtcactgatgaccttgggtaagctctactgtttcatgcatcacgttaccgtgaccagcatgccttgaggggaccatgcttatgaagtgcctggcacacagtggatggacaataaatggcaacagtttgattgtgagctgccacgcatagatcctggggcacagtcaagacacacatgggcccagacaatgcagggtgatcagcgcctgttggggaactgcagcaggtggtggtggggaccctgaagagggatgtcgcctagtggaattccagtggccagactggacccatccctcctgccttctgcagtgtgtggcttagggtcccagccaagggctttttttgtaagcagcagaagctgaatctggccaccttaaacaaacagagggtgtttcctggaaggataccaggtaactcatgaatcaaaggcagaactgagcaagtaggactcaggaaatgggaactctgggagactagactcttttaggacaggtgaacttgaactgtctttggtccttgtagaccactgatgacggttcaaatcctgggagaggggcttttatggggcgacctcagacagtgcccaccttggctgggggaatctgaggcaccctgattgacaggcccaccaaggctgtaggaagagggagagctgatcccttcaaaaagccaacagggggccaggcacagtggctcacacctgtaatcccagcactctgggaggccgaggtgggtggatcacctgaggtcaggggtttgagaccagcctggccaacatggtgaaaccccgtctctactagaaatacaaaagaattagccaggcacggtggtgcatgcctgtaatcccagcttcctgggaggctgaggtgggaggatcgattgaacccaagaggcagaggttgcagtgagccaagatggcaccagtgcaatccagcctgggcgacagagaagaccttgtctcaagacaaggaaaaaaaaaaatgctgagaggatggtggactaactgatgttcagattcctcctcttaggcgcttggtcctcctccgtgcagagtggaattttccagctgcccagttcgacctgtgggctaattggtgggttgagagggtaagacagccttagcgagcactgcatgcctgcagaagctcccagctgaccatggtggctgcgctcagtgacgaacaggagaagtgaaggctgaggcttataggagggtggcctgaggctgctggtaggagagcgggggggctctctgcggcatgcagcctccagatgggggtccctgggagtgttctggaacattctcatccctgcacagagaaagatggttaagggcatggctggttcccagtgtcacacatgtgtgtgaggacaggctgcatgggaagtcctgcttggtatcattcttccttcctgggtgatgtggctatttgtgttttgtttgttttttaagttagtgtttagttagtttagacaaaacaaaacagatgctgacattaaagggaatgtttaaagcagagtttctcagttcctggctgtgcctagaattctctgtagaacctgtttaaaaatgtatttagtaataagcaacacgggggtcgccatcactgaacacttgctgtgccaggcactgcgtgcagtctcgtttcaccctctcgcaaatgaaggttgggtctgctgttcctgttttgcagatgtggaagatgaggctcagacagatttatcatttccccaaggggcacagccaggaagtgagagaacacttcccacatatcacagttcctggagctctaatcgagactcatagcagggactgggctggacacgagggcacctgctcagtttttaattttaattttttggtttattttcttttattcgtgttttttagattttttttttatttttattttttatttttatttttagacagagtctcgctctgtcacccaggctggagtgtggtagcatgatttcagctcactgcaacctccgcctcccgggttcaagcaattctagagcctcagcctcccgagtaggtgggattacaggcatgcaccaccacgcccagctaatttttgtatttttagaatagagttggggtttttccatgttggccaggctggtcttgaactcctggcctcaagcgatctgcccgcctcggccttgaaagtgctggggattacaggtgtgagccaccgtgcccggcggccacctgctcatttataaagccccccgtgactcatttacaaccaagactgagaattcctggcatggagtgcctccctctgtccaggaatgatctgcagccccctcttcccttccaggtgtgtctgtgtctccctgtggctgtttctgcaagattttgcatttttgagctctgcttttattcatgtcatcacccgagcatgttcccagggtcaccctgaccatgctgctggctgcgtatttatcccttttgtatcttctgtcctgggtcctctcccaccttctctggggtcagccctgtggtgccttacattgtgctgctttctctcctggcaccaaagaatgaggcagtcagtgcggagtgggggcagtagtcatcatcatcactgagttattgtgaaccgggaaagagatatgatctgtgttgacacgacacacggtgcccaagtgcacttgataaatgttggctgtcattgtcattgttgatgttccggtgattattgttgatgctgggtggattcttcctgggatcagggcagatatccagctgctgtgtcccttggtgtccttatcagtgtccttcctaattctgcaaccaaggcatctgccagggctggggtctcatctgaagactcaatcagggaagggtccactttgaagctcacctggttgttggcagaacttggttccccagttcaaatgttgaaatactttattactgtggaaacagccactgccccaggtaccttttaccctgaactcttgggacctctctgtggtctaggaactgaagggttaactcctggcactacaggggtctccgggcctctgcctgttggctgatggccttgtcaaattggttatctattttgaatatcacttcttctttcaatgcttgggaatcacggggctatgccctttccctcatgcgtttccttgcatcctggtcctaggaagtgagcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttctgccaggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggacccaaacactgagcagcagaaagatttatcgcaaagagtgaaacaataaagcttccacagtttggaagggtaccccagtaggtggccactgctggctctggcagccagcttttattctcttatctggccctacccacatcctgctgattggtccattttacagagagccgattggtctgtttttacagagtgttgattggtccgttttgacagggtgctgattggtgtgtttacaacccctgagctagatacgtaagttccccacatccccactagattagctagatatagagtgttgattggtgcattcacaaaccctgagctagacacagggtgctgattggtgtgtttacaaaccttgagctagatacagagtgctgattggtgtatttacaatcccttagctagacataaagggcctccaagtcagcaccagactcaggagcccagctggcttcaccaggtggatgccacactggggctgcaggtggagctgcctgccagtcccgtgccgtgcgccctcactcctcagcccttgggcggtggaagggactgggcgccatggagcaggggcggcactcgtccgggaggctcgggccgcgcaggagcccatagcggggaggtggggaggctcaggcatggcaggctgcaggtcccgagccctgccccgcggggaggcagctaaagcccggtgagaaatcaagtgcagcagctgctggcccaggtgctaagcccctcactacccgggctggcggggctgcccggcagctctgagtgcggggtccaccgagccgacgcccacccagaactagcgctggcccgcaagcgccctgtgcagctccggttccctcccgttcctctccctccacacctccccgcaagctgagggagccggctccagccttggccagcccagaaaggggctcccacagtgcagcggcgggctgaagggctcctcaagcgctgccagagtgggtgccaaggccgaggaggcacagagagcgagcgagggctgcgagggctgccagcacgctgtcacttctcaatcttacacagcctaaattctagtgggagactccagacagtgcatgagtgtagaaggatgtaagattttctgtcgaggtgtgtggatgtgtgaagtcctaggtcatgaagcaggaagccccagctccccatttgaattctagattccatccagagttggttccagttgctccctctgccactccctgaaaactcactcttgctttcagatttgagggccacttccacctcactaggccttaactaaagacctttgcacagatctcatgggtaaggaaagtttacccaatcccaggcgctaattcaaagaggggaggtggtggaggtttattcggccttcaggaagtgttttcaggggacacagttctgggggtgcagggatgactcatatggggctcttgacctcagttagcttataatcttgtgcaggagataagtgggtagaggaaagtatagaaatttccacggcagtgagccgcagctgtgttttgcatggtctccataatttcttttcttttcttttcttttttttttttttttgacatgagtctccctctgtcgcccaggctggagtgcagtgtgcagtggcgcgatgtcagccactgaacggaaaactgtgggcgacgcaatctgtgatcatctctgggggtctgcataaagctcatgaccactgatgtgcgaaaagtgcttttttttttttttttgagacagggtcttactcagtcgctgaggctggagtgcagtggtgcaatcacggctcactgcaatttctgcctctgggattcaagcgattctcctgcctcaacctcccaagtagttgggactgcaggtgcacggtaccacgcctggctaatttttgtatttttagtagagacggggtttcaccgtgttggccaggctagtcttgaactcctggcctcaagtgatccgcccacctcggcctcccaaagtgctgggattacaggtgtgagccactgcacctggccaaataatgctttctgagtaacacgcttgcatgaaggagcagtcaggcaagatcccaccccagtgcccaccacatttgtaaaacaagaaaatcgaactagctgggtactttgccctatgtttttcatcatatgttacattttgaatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacctctgcctcctgggttcaagcagttttcctgcctcagcctcctgagtagctgggattacagaaacttgctaccttgcccagctaatttttgtatttttagtagagacagggtttcaccatgttggccaggctggtcttgaactcctgacctcaggtgatccacccaccttggcctcccaaaatgctgggattacaggggtgagcaccgcgtcctgcctgtttttcatttctcatttggtcctaatgattacgtccctgagaaagtcccagttgggtcctaccctgccttctcaacctatcaaccactatcctctctttgtaacaaggagaccgggttttgagctcctgttttattgtttttaaagatcgtctattttgggcaagtgttaataattctccatttatggtggtgatccaaagtttatttttaaaaataaatgtggttttttttgtttttgtttttaaagggaatggaatttttaaagtaggtaaaaaataagcatgcagataaagaaaaacaaaaaaaaaaacatgaaaggtggtagccggggagtggggctggggcactttctcttagatctgcccggatgtgtccagagcttccgaggactgtctgttcctggcttcttccttaacttgtcatcagagtcaggaccgtaacaaggggcagaggtgactctggtgtcctctctcgccttacccttagtgaccctccaggaagccagagaagttaccccaaatcgcaggacatgggaaggaagggccagagatgccaggcccatttaatcctcatttaactccaattttatattcaaggaacatcaaagccagggggcttgttacttgtcaaagttggacccagagtggagccaggcacaacacgcttatcgtttctttgtgtcttttttttttttttttttttttttgagacgaagtcctgctgtgttgcccaggctgtagtgccgtggcgctcaccgcaacctccgcctcccgggttcaagcaatttacctgcctcagcctcccgagtagctgggactacaggcctgcgccaccatgcctagctaatttttgtattttcggtagagatggcgtttcactatgttggccaggctggtctcaaactcctgaccttgtgatctgcctgcctcagcctcccaaagagctggtgctgggattataggcatgagccactgcgcccggccttttttttttttttaatttgttttcttttttttttttctgagacaaggtctgactctgtcacccaggatggagtgcagtggcacaatcatggctaactgcagcctccacctcccggattcaagtgattctcccacctcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagagcctcactgtgtcgctcaggctggagtgcagtggtgtgaccaacgctcactgcagccttaagcttctgggttcaagagctcctcctagctcagcttcctgagtagctgggactataggtgtggaccaccacacctagctaattttaaaattttttgtagagacagggtcttactgtgtttcccaggctggtctcaaactcctgggctcaagtcattgtcctgccttggcctcccaaagtgctggcattataggtgtgagccaccgcacccagtccagatgattttcatgacccaaaattcagcatgaaaagcttgaaatgacaatgagcacagacacgggtaaagatccctggaatttcttgaaaccaagtcaggtggtttaggtgggggctggcctaaagcagattgccctgtctctcatgtcaggcggctagacacatttgtttagccccatgctgggctccacagggaatataggagggaaagaaactccaaccttcacctcctggagcgaactgggcactgggaagatgggtgagatggtattctgtgctcagagtgaaaagagttggaggaggctggcccagttgtggtgttgaggtgacatttggccttggttgccaggcaacatgtcacacgttgcttaaaactcattggtggcttctgctttctgtcagtcttggctaaaagttggaatcctgacccgagtctcccatgccatgtgtggtctgactgcgaccggtttttccagcctcttgttccttgctgccccatgatctcctggctccagccaccagtgccttctctcagttccccagatgcactgtgttccctcctacctcagggcctttgcacatgctggttctgccaccttttttccattttcagctggtttaactcctttttttttttttccccctggaggcaatgtctccctctgtcacccaggctggtgtgcagtaagtttggcttggtgcaacctccacctcctggcttcaagcgacccttgtgcctcagcctacaggcatgtgcccccacgcctgactaatttttgtattttttgtagaggtgagatttcatcatgttggccaggctggtctcggattcctgacctcaggtgatccacttgccgcagcccctcaaagtgctgggattacaggtgtgtgagccacgatgcccagcactctttatttttttttattttttagagacagtctcactctgtcacccacgctggagtgcagtggcgcattctcggctcactgtaacctccgcctactgggttcaagccattctcttgcctcagcctcccgagtagctgagatgacatgtgcctaccaccatgcccagctaatttttgtattttagtaggcaaggggtttcgccatgttagtcaggctggtctcaaactcctgacctcaggtaatccacccgcctcggcctaccgacgtgctgggatcacaggcatgagccactgcacccagccttggtttaactctttaatgtcacttcctcgaagaaaacctcccccaatacctctctagactgcattaggtcaggttgtctgattttatactcacgtggaattgtgcaccgtttacagcccttctctgtgatgacgcatttatctgggatgattttatgggagcctatctcaccacgcgactggaagctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtcacagtgacagagcttccatgaggtctcatttgcggacttttgcctgctgagtgagggcggaaattggcttatactagtaattcccaattatgggcagtgttgtccctcagggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttctagaaaaaatagataaataaaataaactacaggtcacgtggtggtatgcgcttgtggtctcagctacttgggcagctgaggtcacaagattgcttgagcccaggagtttgagcctacagttagacctatgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaactgaggcccggagaggttgagtcagttgccaaaagtcacacagctaatacatggcagcattggcattgaacaaggcagtctggctcaggagctcacgctgttatccactgtgctacgcagtatgtgagccatgtttgcaaatacacatgtatggtccatatgatatatacacagtaaatggatagtcttgacacatttgagtacttctgtatgccaggcacattgccaggtggggacttcacattccacagtgctccgaggtcagcgtcattgtcccattttacagatgaggaaactgagagattcagtgaccagtaggaggtcccatagctggtaagtggcagagatgggatttggcagcattggctccagagcctgttacttgagcccctgcctattgggtgtcttcccgattaaagaggccgagatggaagcctctctgttcctaggaagttgctgctctggaacacacagtgcgctcctgtggattgtttgagagaagcaccagtgtctcaggatctccaggaggtggctttgggaaaacccagcggtagcagagcacacatggactccttgagtctctcaatccctcccctcccctctccttgccattaggggaaaggactgtggcctacaaattataattgagggaaggtagagaacagagagggtgtggtattacctgaactcacacagcaacaacgtctgttccagagctgtgctgtctggtgcggtagtcacaagacacaggtggctattttaatttcagctgttaaaattaaataaacgttgggcgcagtagctcacgcctgtaaccccaacactttgagaggccaaggcgggtggatcgcttaatccaggggttcaagaccagcctgggcagcatggcaaaaccctgtttctacaaaaaatacaaaaattcgctgggcgtggtggcgcatgtctgtaatccctgctactcaggaggctgaggtgggaggattgcttgagcccaggaggtcgaggctgcagtgagccgtgatcacagccctgtactccatcctgggtgacaggatgagagagaccccatctcaaaagaaaaataaaattaaagatttattcgattagactagacacgtttcaagtgctcagtagccatcatttcagaaaattatctcagcactgttctaaaacagcgatccctagcctttttggcaccagggactggtttcatggaaatggtgggtggtgatttcgggatgaaactgttccaccttagatcatcaggcattagttagattatcagaagaagcgcacagtctaggtcccttgcatgcacggttcacaatagggttcgcactgctaggaggatctaatgccaccactgagctcacaggaggcagagctcaggcgctgatgctcaggaggtgaccaccactcacctcctgctgtggggcctggttcctaaccggtcatgagctgctgccaatctgtggccccggggttggggacccctggtctagaagaatatggcatggggattaagagcaggctgtctggattaaaatcccagttctgcttctgctaggcacagtatactaagggcaaaggcgttcacctatctggacttcagttttcttatctgtaagttgggtagtaatagaagttattcagagtcatcataaaaatcagttacatgtaaaacccagcacagtgcttagcacataggaagtaccctctgaataatagctgccattatcatcatcattattattactatttttttttttttgagacggagtctcattctgtcgcccatgttggagtggagtggacgcagtcttggctcactgcaacctccacctcccggattcaagcaattcccttgcctcagcctcccgagtagctgggattacaggcgccaaccaccacgcctggctaatttttgtatttttaggagagacggagtttcactgtgttggccaggctggtctcgatctcctgacctcaagtgatccacccacctcggcctcccaaagtgctgggattacaggtgtgagccaccatgcctggttcatcattattattattattagaagttgggagtccaggcctgcctcgtccacatggccactcctccctgcagtgcctggtcagctccctctctgcattgtggagttttaactccgagtgtctgcagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccaggtaaggggtgaggtcttagtgttcgggacaagccctactgtgcattatataccagtgttacctaaagccttgttttatcttaccatgtccccagtgtggtgcttttgaagcatgtagatttgtttttgtcagtttcgaatacctaaattgtttttttgctcacaataacaaaatgcactttttttgtggaatgcagttttttcctaagttttacttttccacctgtcaattcaaaaaggaaacaaaacctatcactataaagacaacttcattattaaaatttctttttttttcttgagacagagtctcgctctgtcacccaggctggagtgcagtggcacaatcttggcttactgcaacctccacctcccagttcaagtgattcccctgcctcagcctcctgagttaacaggtgcgcaccaccacggccggctaatttttgtatttttagtagagacagggtttcaccagtgttggccaggctggtctcaaactcctgagctcaggtgatccacccacctcgacctccccaagtgttgggattacagatgtgagccactgcgtccagcctaaaatttcttcaagtataaaattctttagttcttaagcctcctgcaggaggcaggaactaaacaaaaaacatgactaatagcagcctaaataagatagacgttttctttttctctgtcataatagaaatttagaggtaggctgttcagggctggtatggcagcttcatgagtttaatatcccagatacctgcttttatttaaaaatttaaaaaatcttaccatatttatacaagcctttcattctttctttctttcttttttttttttaatttgacatggagtctcgctctgtcgcccaggctggagtgcagtggcgcgatctcggctcactgcaagctccacctctcgggttcacaccattctcctgcctcagcctcccgagtagctgggactacaggcgcccgccactacgcccagctaattttttttgtattttcagtagagacaaggtttcaccatgttagccaggatggtctcaatctcctgacctcgtgattcgcctgcctcagcctcccaaagtgctgggattacaggcgtgagccactgcgcccggcccctttcattcttaagttggcctcatggtccaaggtggctgctggagctccagccattatatctatatttcagtcagtgagatcaaggaagggaagtagggcaagggagcatatgggtgctgaatcagcactactcccttatctgcaggcacacattctaagactcccccaatggatgccttaaactgcagatagtattgaatcctacatatcctgtttttttctgtacatacatacctatgataaagtttaatttataaatttggcataatagattaatagcagtaatttataataataaaatagaacaattataacaatatgccagtatcactacttctccacattagaggcgttatttttattacttttttttttgagacagagtttagctgtgtccttcaggctggagtgcagtgatggaatctcggctcactgcaacatctgcctcccgggttcaagtgattctcttgcctcagcctcccaagtagctgggattacaggcatgcgccacacccagctagtttttgtatttttagtagagacgaggtttcaccatgttggccaggctagtctcaaactcctgacgtcaagtgatccgcccgcctcagcctgccaaagtgctgggattacaggcattgacccactgagcccagccaggggcattattgagtaaattcggattacttacccataagcactgcagtacaatggccgtcagtctgataaccgatatggctattaagtgactaaactgacagggagggtctgcagcatggacctgctggacaaagggatgattcacaccgcggatgggactgggggggatttcatcacactactcagaagggtgcacaatttaaaacttacacattatttttggaccacagttgaccatggataaccgaaaccatgtgtgttagtttgtcctcatactgctatgaagaaatacccaatactgggtaatttattaaggaaagaggtttaattgactcacagttccgcatggctgaggaggccatggcagaaggagaagcaaacatgtccttcttcacatggcagtaggaagaagaatgagagcaccacgaagtcggggagcccccttataaaaccatcagatcttgtgagaactaactcactatcatgagggttgggggaaactgcccccacgattcagttatctccacctggtccctcccatgacacatggggattaagggaactacaattcaagatgaaatttgggtggggacacagccaaaccatataaccacggaaagtgcaaccttggattagagggacacctgtacatctaattgtccagaacttagtcatgggaccacctctattcacaagggaccctggaaagtgccgtgttttagctgggcacattgcacttcccagcaaaaactttcagttgggcctaggcacggtggctcacgcctgtaaccctacccctttgggaggccgaggcgcgtgtatcacctgaagtcaggagttcgagagcagcctgaccaatatggtgaaaccccacctctactaaaaatacaaaaattagccaggtgtggtggcatgtgcctatagtcccagctgctctgaaggctgagacaggagaattgcttgaacctgggaggtggaggttgcagtgagccaagattgcatcactgcaatccagcctgggcaacagagtgatactctgtctaaaaaaaaacagagaagtttctgttgggaaaggagaaattgtgtaggcagtcagtcgtctctgctgcatcccttctgcagaaacggttatatgttctttgttctttgaacacatgtggtttcttaggatatcgcaggatagataatgttttcaattgacaggtggagcatcttgctaagtgggagagctgagagtgcaacctcaagtctgtccaattccaaaactgctgttaccgctaaaggattaaccgcagcacaattgccagtagggatgggttgtttagatgggagcattccagctgcaaagcaaaacaagagtaagaaaccatgaggctcaccatatctcaaaccacgctgcacagctgttcaggtggcatccagggggccttggttcaatcatgtggcccctgcgccccaccacactgtggcccaatgattgatgagaacgaacagtgatggaatcagagagagtaggtccagttcctggagtctcgttatatcctcttgaaattggtgccagcttttttttttttttttttttcccctgcatttaccaaatatgttatctgtgttcatacgcaagctggaaaatttcctgaaagacccaaaaagaacaaaacaggccaaatgcagtgttgaaggcaacttaaatgtctgccaatagcaggaccttgggtacaccgtggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaatagttaattttttaatggcttttggctaaatttacatttatcctctcactaggcagtctcattcctaagtgtatattaaaaaaaaaaaaaaaaaaaaaagagcaaaggcagtgcttagaatgttctcagcatcttgattcataatcgcccaaactggaaacagctcaaatgtccattaacaggaccgtggagaaataaattgtgatataattatacaatttatggttgagtagtaaaaaggaatgaaatgctaatacacaacaatttgggtttatctcagagatgttatagtgatcaaaagaagccagacgaaaaagagtaggtactgtgagatttcatttatatgaagttcggtcgggtgcagtggctcatgcctttaatcccagccctttgggaggcctagacaggaggattgcttgggcccaggagttcgagaccagcctgagcaacatgggaaaacctggtctctacagaaaatacaaaaattagctgggtgtggtggcgtgaacctgtagtcccacctgcttgggaggctgagatggaagggtcacttgagcctcggaggcggaggttgcagtgagctgacattgtgccagtgcacttcagccttggtgacagggcgagttgtctgaaaaaaacatcagatcggcagggcaggtggatcacctgaggtcaggagtttgagaccagcctggccaacatggtgaaaccccatctctactaaaaatagaaaaattagccaggcacggtggtgggcgcctgcaattccagctacttaggaggctaaggcaggagaattgcttgaacctgggaggcagaggttgcaatgagccaagattgtgccactgcactccagccagggtgacagagcgagactgtcttaaaaaataaaataagatcattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccaggaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagctccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggagaaggtgctcatggaggatgggaagggcttcccgaggaagtgacatctgtgctcccatctgctgggtgatgaggaatggcctggacgggatgggcatggtgggtggaggcaggcggcctgtgtgcagggaaggaaggggagagttacaggatgagatgagttgagggaagaagcatggttggcaactctaacagcgctgggaggccatcggaggggggtgacgagattgaccctatcctcatgggcatctcagctgggctgagtgtgctggaaccggccattgcatggacacagtcactcctgaggggatgtgatcaacaggcggaattctgtcacttaatgataacaatagtcaccagctaactgaatgcttactgttaggtcaaactatatgaaactgctaatacttatttcttatctacagaaacagctatttcctgtggttcaacctagtattaccaggcactgtgcttagtgacatcatgcatatctatatgatttatgaaataatgtgtccacgcaaatacacatcacatgtaagactgtaactcttacatgtcaccctcacaatgaccccgtgaagcaagctttgttttgtttcgtttgttttcttaataatattttatttttgtagagatggcattttgccatgtgcctgggctggtctcagactcctggcctcaagtgatctcccgcctctgcctcctgaagtgcgggtattacaagcatgagccaccccacctggccgagcaagccttgttgttcccattttacagataaggaaactgaggcttagagaagtaaagtgttagtcgtgtttatattgccagtcagtagttgagtcaggatttgaactgaggtctcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctgggcaacatagcaagacccccatctctcttaaaaaaaaaaaaaaaaaaaaaaagtagcccatcatggtggtgtgtgcctgtagtcctagcttctcgagaggctgaggctggaggatcgtttcagcccaggagttcaaagttgcattgagctatgattacaccactgcactccagcctgggtgacagagtgagaccctgtctctggaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccctgaatgattacagaccttgacttcccttcagaatttttagggagtttgtcacaatctggctgtgtctgtcggagtagtgaggatcagtcacttggttcataagggctgcaatggagaaaagatcaacaccccatcttcctagaatgctttatattttagaacattaaaataatagttctagtgctatatgatatcatacgaagcctagctttaaacaaataagatggccaggcgcggtggctcacatctgtaatcccagcactttgggatgccaaagtgggtggatcacctgaggtcaggagttcaagaccagcctggtcaacatggcaaaatcccatctatattaaaaatacaaaaaaattagccgggcatgatggtgggtgcctgtacttgggaggctgaggcaggagaatcacttgaacccaagaggcagaggttgcagtgagccaagaccgcaccattgcactccagcctgggcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaatgacagaaaacatgatttctgtttctattttaaagggtaaaatagtatattttaacactttgaaatgaagagtctgggcttgggaacgttacaatgatgtttactcgtactagttacgcactcccctcccagatctgtctcgtaacaagagactgttattttctacttgtttttagccaaaaggccgagaaacgatggttattttaaatccctagtgtctcttacagttgatgtcttcttagtatttaggaatttccaggacatctttttgttgttgttaatgcactgtgtgtgtgtgtgtgtgtgtgtgtgtgtgtgtgattataggagtgacccactacgcccggctgtgtgtgtgtgtgtgtgtgtgtgtgtgtgtgtatgtgtgtgtgtgtgattataggagtgacccactacgcccggcctatgtgtatgtattttaaaggcttcaatgagaaaaaagttggttcttaaaaaggcaagcttcagattccagggaagattgcctctggagagctctgttttaatccatgggtttgccagattaatgaggatttactggcctcgtgccttcggccctccctaccctgcgcccattgtgcatgttttgaaaaagcagtgccaggaaggactctctctggaattactgcggagttacttgagttagcaaagaatccccttcctcccccaagagctgtaagccaagtctctgtagagctgactccatgcctgtttgtctgcctgtgtgtcttggcgcaggtggctggccgtgcggctggagtgtgtgggcaactgcatcgttctgtttgctgccctgtttgcggtgatctccaggcacagcctcagtgctggcttggtgggcctctcagtgtcttactcattgcaggtaagaggggatgctcttggctggattattaaagtctgttaatgggggagccagttgtccttggctttggattccagctccaacaggaatgggggagaggaacttgagaggtacggagtttgaggagcaggtacagtgccacagtgcctggtgaccaactagagcaggagacggatttgacatgtggccaggattttccccatcagtcacacagattccttagtggcccaagaggatacttccaggtacgaggggaatgcttttaaagctatgaatttccctctaagaactgctttagctgcatctcacaaatgatgatacattgtgttttcatattgtcacctggctaaaaatattttccagtttcttattatgtggcccatgagttattttggaaatgtgtgtgcttaggagatggcaatgtggcaggcctgggtgatggctatacctggggttgctaatttcggtacctttcttacctgaatgtttcataactcataaccttttatttttatttatttattttttttggagacggaatctcactctgtcacccaggctggaatgcagtggtgggatctcggctcactgcaacctctgcctcctgggttcaagtgattcttctgcctcagcctcccaaatagctgggtttacaggtgtgcgtcaccatgcctggctaatttttatatttttagtagtgactgatggggtttcgccacatcggccaggctggtctcaaacccctgacctcaggtgatctgaccgcctcagcctcccataattcatacttgttgaaaataatttgtttcctattatctcagtggaaaaaaagaaaaaggaaagtcaagtacgcccgcttactctagaaatgccacgtgactcttccactcacaggtcaccacgtacttgaactggctggttcggatgtcatctgaaatggaaaccaacatcgtggccgtggagaggctcaaggagtattcagagactgagaaggaggtaggcaagggcccctggctggacctcttggtctttggtgtagctttaccccaaggagatctctggaccctatcctgtgcacctctgcctctgagctggatacctcaccaggtagaagtgcatcttaacgcttgtccagtctttttgcagcacttatttagagcccggttttagggtgaaaatagtttaccggctttacccaagatctggggtatccatatacgagactgtgggatgctgtcagggcattcagaaggtattcacattgtgaagaagtttccccctctatttctctttcataacttctgatggtatcacagagaaagtcttagtctggggctagcaggtctttaacaccttagcaattgagatgatctcccttcaacagacagataaacagcagccctcacacttggagtcttcaacaggacggattctgtctatcagaaataaccttctgttatttgttatgaatttggtttttttgtgtgtgtgatggagtctcactgtcacccaggctggagtgcagtggcacaatctcggctcactgcaacctcctcctcccaggttcaagtaattctcctgcctcagcctcccaaatagttgggattacaggtgcctgtcatcatgcctggctaatttttgtatttttagtagagatgggggtttcactaagttggccagtctggtctcaaactcttgacctcaggtgatccgcctgcctcagcctcccaaagtgctgggattacaggcgtgagccactgcgcctggcctgttatgtatttgtataggggactcctgttacggaaaataatactacttttccttttgtgattgtaataaattttcctcttaagtaagttgagaaattaagtctaagtgacttgattaagcatattaaaacaacaagagaatgagtacatgcatactacacgaatgatgtagctgggaactgaccaaagtttgggaaaccctgccgttattgaaccccagtcccctttttatagatggagaaaaagggaacctggggagggacaacagctgatccaaggtcccacgtggcttggtagaacagctgggactaggacccgtgcctccagtctttgatgttgcgttgcccttaataactgccttcttaggccctgaacagcagcacaagtaggaacagcagtgataatagataatcacaataatgcctggcgacacccccaccctacattaatgataacagggacacacatagtgccttgtagaatgtcaggcccagacttaaacgtttaatatagagtaatgcactcagtctttaccccgctctatgactgatttttgagacacggtctcactcttgcccgggttggagtgtagtgcgatctcattcgctgcctcccaggctcaagtgattctcctacctctgcctcctgagtgtctgggaccacgggcatatgccatcacaccggactgatttttgtatttttagtagagacgggattttgcccagactcatcttgatctcctgagctctagtgatctgcctgccttggcctcccaaagtgctgggattacaagcgggagccaccatgcccagcccagccctataatttagatgctactattacccccattttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgaggagagatgccccttgggagtgagaccaaggcctctgtaaggtctgtcctcctgaggaattcacagaggtgacctcggcccactcctttaacattctgactgggtgaaccaggtcccatgtcacgggtgagcattgtaagaatggcgtgagtgcccccgtgaggaaccaagggtgtattacaccggcggcttccaacttgacactgaatttaattcacttacaaggtatttcattaggttttttttttttttttttttagatggaatttggctttttttttgcccaggctggaatgcagtggcacgatctcagctcactgcaacctccacctcctgggttcaagtgattctcctgcctcagcctcccaattagctgggattacaagtacccaccaccccgcccagctaacttatttcattagtttttataatagcctcattgacatgtgaatttcacatgccatggaattcacccagttaaagcgttcagttagattgaattcagttttttttttgtttgtttgagacttaagtctcgctccagcctggagtgcagtggcatgatctcagctcactgcaacctccttctcctgggttcaagcgattcccagcctcctgagtagctgggattacaggcgatttttgtatttttagtagagaagggatttcaccatgttggcccggctggtctcgaactcctgacctcgtgatccacccgcctcagcctcccaaagtgctgggatcacaggtgtgagccaccacacccggcctgagttcagtttttaaaagcattttacttttgactgacttttatatttttagaaggatcgtgtttgacaaacccaagagaaagtaattgtcctcattagtcctaccactattctgtatttgcatgtatttttatatatagatagaaagttccacatacttctctccattccgctcactgtgttgttatagcatctccccttcaattatgtacataaattataaaatagagatacacttgttgttttaaaaaagaaaaaatcaatacagggctggacacagtggcccacgcctgcaatcccagcactttgagaggccaaggtgggtggatcacttgaagccaggagttcgagaccagcctggccaacggtgaatcccgtctctactaaaaatacaaaaattagttggcatggtggcaggtgcctataattccagctacttgggaggctgaggtgggaggatcgctggaacccgggaggtggaggttgcagtgagctgaagaaacatcactgcactccagcctgggtgacagagtgagactctgtctcgaaaaacaaaaaaacaaagaagtttatggtggagaaagacagtttgttcctgttcgccccgttcctctcctctccagagagaggccccattagcattcgggtgaatttcccccaaaactttcccgtgtggattcccacataccccaacacttttgtttgcttgtttctttttcttttaacgtaagtggaatctacctgttatcctgtgaaaccttttctttaaccatgaggcacctttgcatctgtgtatagtaacagtcactgcctctaagggctgctgtgaggctcagatgagatcatgggtctcaagtgctgagcagagcaacttgccttagttgcattgtaagcgctcaataataacatttattttttggccaggcgcggtggctcacgcctgtaatcccagcactttgggaggccaaggcagatggatcacttgagcccaggagtttgagacgatcctgggcaacatggtgagacatcgtctctacaaaataaaaaataatactttttgttgttggcggtggtggtggggtttttttttgtttttttttttttgagacagaggagtcttgctgtgtcacccagactggagtgtagtggttttatcttggctcactgcaacctctgcctcccagattctagtgatcgtcgtgtctcaacctcccaagtagctgagattacaggctcccaccatcaggcccagctaatttttgtatttttagtagagccagggtttcaccatgttggtcaggctggtctcaaactcctgacctcaagtgttctgcccacctcggcctccctaagtgctgggattacaggtgtgagccactgcgccggcaacgctgtgattttatagcacgtccacaaaagggctgcatgtcttgcctaaaagttgcccggcgttttcttgttatgtgccgtctgcagtgcccctgagcttggccatgtgctctgcagcctggttcagcacctgtgtgtgccctggacggggaggtgcattccccgaggctaaaaccagtgaacctggcccaggccatatccagctgtgggcctcaggaaatgctgaactgaactacttttcaaaaggagggttgtgtgtccctgggcaagttaccgcccctctctgtgtctcagtctccttgtgtgtaaactggggataatgaaaggaccctcccacatggggttgctgtgaggattggatgagacactgcgatacagatgctgcttttatccttgccttcctgccggggtgggcagccagggtaactcacttttattgtcgtgtctgtccagagaagaccactcatttcattgactccatttataaatatttatttaaatttttttttatcaaaaagtaagttttattggcatctaaaaacaaaattcacccaacactgaaacatacttcaatatttatgttattgttttcttgtttcttttttactcactgcagtgtgaggaacaaatcacatttactttggagaaacagagaccatagtgtagattttacaaaatcactttttaaactctctgtattgcgctcctcaaatacctagagccagtctgtgcataacatggcacactgttgtctaaaccgtaaaattttgcatcagcctaaagatatggataagatatacctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacagcttgcagaagtgaaggcttttaggtgaactgacagcctgaagaccaaatgagccccacagatttgttttggaagattttttgttgttgttgttgagagagggtcttgctctgttacccaggctagagtgcagtggtgtgatctcagcccactgcagcggcagcctcccaagtggggggactacacatggttgggagtgcaggtgtgtgccactgcacctggctaatttttgtattttttgtagagatgggggtcctactatgttgtccaggctgatctggaactcttgagctcaaccggtctgcccgcctcagcttcccaaagtgctgggattacaggaatcagccaccattcctggcccctggaagaagttctttttttgttttttggttggttgtttttttttttttttttttttttttttttgagatggagtcttactctgttgccaaggccagagtgcaggggcccgatctcagctcactgcaacttctgcctcctgggttcaagtgattctcctgccttagcctcccgagtagctgggactacaggcatgcgccaccatgcctagctaatttttgtgttattagtagagatggggttttgccatgttggccagggtggtcttgaactcctgacctcaactgatccacccgcctcagcctccccaagtgctgggattacaggtgtgagccactgcacctggcctggaagaaatttgaataagttgcaaatactgaaaaatctggaagacttaatataaaaatttattttctgctttttttggaagatcagaacatctggcaacatcaggtcaatcctcccccgcctggctctttctagtcaacctgtgagcctcctggttcaccccagtccctccctgtcccattcattgcctagttggcccctccaaaacattagaatttgtgatctctagaataaggtgtcaccatcccttctagggggatggctcaagggaagtgagaaattgtcagaattttggaaccttctcttggttccgagctgttcttggaagaggttccttgacctgagtgatacccttagactttcctctggaattggtctgacagtcttcctggccatttgctgggggacaaggctgctttcacctctgaacatatggacttattgaactgttcctacgtacctcccacaaagctcagaacattctgttcccagcagataatttctctctgagttacagagaagagcagagtgggtgatgttcttgctgtctttttttgtttttgtttttgtttttgtttttgttttgttttgttttgttttgagacagcctctcactctgtcacccaggctggagtccagtggtgctatttcggctcactgcaacctccgtcccctgggttcaagtgattctcctgcctccgtctcccgagtatctgggactacaggtgcatgccaccacgcccagctaatttttgtagttttagtagagatggggttttaccatgttggccaggctggtctcgaactcctgaccttctctgatccaccttcctcggcctcccaaagtgctgggactacaggcatgagccaccgtgccccagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtgtgaaaaacagtggggaaatgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagactttttaattttcgattcacggggtgcacctgcaggcttgttacgtgggtatattgtgtgatgctgatgcttcggcttctatggatctcatcacccaactattgaacagagtacccgagagagagtagtttctcaaccattaccctcctccatctgtccccacttatggaggctccagtgtctatcatttccatctttacaaccatgagtacccagagtttagctccctcttacaagtgagaacacacagtatttggtgagaaataaggattttctttttctttctcttttcttttttttctttttttaactgagacggagtctcactctgtcacccagtgcagtggcacgatctcagcttactgcaacctgcacctcctgggttcaagcgattcttctgcctcagcttcccaagtagctgggattataggcacgcaccaccatgcgtggctagtttttgtatttttagtagaaacggggtttcaccatgttacccaggctggtctcaaactcctgacctcgagtgatctgcctgcctcggcctcccatagtgctgggattacaggggtgagccaacatgcttggctgaaataaggattttctagaccaatccccgcaggtggattccttaatatgttgccttttagtgtaatcttccctaaagtgtcttagaagattctcttctgtggttggatgacgggagaatccacgggactttactgttaggaatcacctgtgctgcgtctcatttctggaggttctcaacccacttgcatattgaaggctccaggaagttgtatggaaaggaaatctgttgtattctgccaaactcagactttccagacttttttttttttttccattattaaggcaattttttttttggagatagagtcttgctctggagtgcagtggcacaatcttggctcactgcaacttccgtctcccgggttcaagtgattctcctgcctcagtctcctgagtagctgggactacaggtatgcaccaccatgcccagctaatttttgtatttttactagagacagggtgttgccatgttggccaggctggtctcgaactcctgaccttaagtgatccactcgcctcggcctgccaaagtgctgggattacaggcgtgaaccaccgtacctggcctttttctccattattaacatctccagaaatagtgattccaaggagctctgataccccaccttcaacagtcctggccagaagtccttaggtcgcctccatccatgtcagcgtgacacaggtgtcacatgccgtccactctcttctctctgaacaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggtaggcgggggtgaacaaggagacaccgggtaaggtgtcctaggcgccatctcggtaggggtgtttgaagattctgtccagatctgtgtcacctggatttgagtcccagatgaccatttgtcccttcacctcttggagcctcagtttctgtatctgtaaaacgggtctcaatccaggctctttgtaccatgaggtagaataaccaggatgaccagtacatttccttttatacacaccagctccattcagttgatagtggctgtcagttgttaagctatggaaagtcttctgtaccagttggtcactagcactgctctgagcccccaggtccccatgcactaccccagctgtcttggtctctaccaggatcctggagctctgtccatgacccagcaactaaagcattaatgcctggcacaccagcggaacctctggggtcctgctttggtggtgtttgttagtgcctggttctggttctgttatccgtctccatgacaaccaaccataaagcctcaggcatgttcaaccataaagcaacgatcattgctgccatacgagggcagtcagccaggtggctctgctgatctcggctgggctcacatgcatgtctgggagtcagctggctgttggctgatctcggggtcagctggcttttggcctcaggtggggcaagaagggtatgttccgtgcatccctcattctccagcagaccagcttgggcatgttgtcatggcgatggcaggggcacaagagcgtgcaagcccctattgcatctaacagtattcttttggctgtccttacttttgctggtgtcccattggccaaagcaaggaacatgtctgattccagagccacctctcatggccccacagttggataagggatgcatgggtatgaggccttttttttttttttttttttttttttttgagacggagggtctcactctatcacccaggctggagtgcagtggcgcaatctcatctgcaacctccgcccccaggctcaagcaattgttctgcctctgcctcctaagtagctgggatgacaggtgcctgtcaccatgcccagttaaattttgcatttttagtagagatggggtatcaccacattgtccaggctagtctcaaactcctggcctcaagcgatccacccgccttagcctcacaaggtgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgcacctgcggtgttcccagacactggggactctgtaggctgctgtcagacaaagtccctgcctccaggaccaagtagcttattagatggaggagacaaaaaatatacagagcaataaaccaacaggattccagagggcagcaggtgctgggaaggacgcttgccaaggagacgggatagcgagtgctgggcagggccactgtttccattgaacactgcaggcccagtgcgtggggcccacaaaaaggttttattttttttaaaaaatcagaagcaggccaggtgcggtggctcacggctgtaatcccagcactttgggaggccgaggcaggcagatcacctgaggtcgatagtttgagaccagcttggccaacacggtgagaccctgtcaccattaaaaatacaaaaagtagccaagtgtggtggtgcgtgcccataatcccaggtacttgggaggctgaggaaggagaattgcttgaacctgggaggtggaggttgcagtgagctgagattgtgccactgcagtccagcctgggcaacagagtgagactccatctcaaaaaaaaaaaaaaaaaaaaaaagaatataatccaacctggattttatttatactaacacagtcataaaatagaatttctagcattttgtgtggagaaagccacctccgtaggcatcagtgccggggaccacaaaagtcagaatgctgccatagtgccagggtcctggggggttttgagttttgtgtgggtcatctctgaagaggtgacattttagctgagacctgaacaatgaaaaggagtcagccttgagaagatctgggacagcgatctgcaaccttgttcttaagggccggggtagtttcagctttgtgggccacatggcctctcagccacttgactccagtgttgccgtgtgaaagcagtcatagatagtgcacgaatgaatgagcatggctatgttccaataaaactttattcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttagagcaccatgtaaccacggtgagaagcttggaacttactctaagagccctataaagccattggaaggttttaagcagggaagtgacatgagtttctattttattttatatatttttgagacagggtctcaccctgtcgcccaggctggagtgcagtggtgggatcacagctcactgcggcctcaagtgatcctcctgcctcagccttccaaagtgctgggattataggcgtgagtctctgcacccagctgacatgatgtttctagttcactgagtaccacctactaagtggcagatgctgagttggtgcttttgaaatataggacatagaaatgaggacagaagtgggcagtgtcaaatcttacaggacctaaaatattaggggtcagccaactatggcccacaggccacagatctggccccctgcgtgtttttatgaataaagttttattggcacgcagccacatctgttcattttcctgttgtctctggcagctttcacactataaatacagcagagatgcgtagttgtaacagaaagcatatggcctgcagagcctcaagtatttactatctggcctttttcagaaaaatgttgccaatcgttattgtagactgtggtaagatctttttattttactctgaatgtaatggaacagtgaatgtgaacagtcaacactgttaataccattcacaccatgattgatgtggggtagatattaaggagctggcctcatgggaatctgacattgactagaaatagggattgagggtgagcaaccagctggaaggtactgcaccagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgccctccccctgcccttttttttttttttttttttgctagaggcacggtctcactctgttgcccaggctggtgtgcagtggcacgatcatagctcactgcagcctcaaactcctgggcttacgcaatcttcctgcctcagcctcctgggtagctgggactacaggcatgtgcccagctaatttttaaaaatttttatagagtcagggtcttgctatgttacccaggttgttcttaaactcctgggctctggggatcctcctgcctgagcctcccaaagtgctggggttcaggcacctggcctgaaaatccctttatgttagtccagagaggcgaggctgcgctgcagtaacaaattcgccgtaaaatcttcggaaatgatcacaaggctttatttcttgctcacgcagttcttggtgagggtcagctgcctctccagggtaggtgacttccctgtgacaagtgatccaggctgtcctggttttgtgacatggcctcccaagggttggcctccaggtccccacagtgggagaagggagagtggacgactctcacccactcttctgtgtctgaaaccggaactgacgcagttaatcccactcacagcccattggccaaaatgagtcacatggccccaacccaaccactgcgggagctgggaaatggagcggtgcctgtggaagagaaggatttctccctttcctaactgatgtggttctggagttttggatagcggagtagtcagactagtgtgttcggtttctaacttcgaactgggtgagtctgggcagtaaggaatgtctgtatttggggagcacaccatttctgccacacctaaaaccatgcaccaagtacatgtgcagatagaacgttctagcactgccattgttccctcaagctttcctgtcccctgattgaaattgttggcttgcactagggactgtggtgtacaaaggtgctcagggaagagccggcgaggtggtgaccattagaatgagtagtagtgtctgggtgcagtgactcatgccccattgaaactgttggcttgcattagggactgcagagtgtgaaggtgcctagtgaaaagccagtaaggtcataaccattagaataggtagtatcagccagccgggcatggtggctcatgcctgaatgatgtcattggcttgcattaggaaccacagagtatgaaggtgcccagtgaaaaactggtgacgttgtgactattagaattagcagtattggctagacgaggtggctcatgcctgtaatcccagcactttgagaggctgagacaggaggactgcttgagctgaagagttcaaaaccagcctaggcaacatagtggaactctttctatataaaaactttttttttgttaaattagaagtagttgaggctgggtgcagtggctgacgcctgtaatcccaggactttgggaggctgaggcgggtggattgcctgaggtcaggagttcaagaccagcctgatcaacatggtgaaaccccgtctctactaaaaacacaaaaattagttgggcatggtggcacatgcctgtagtcccagctactggggaggctgacaggagaattgcttgaatgtgggagataaaggttgcagtgggctgaaatcaagtcattgcactccagcctgggcaacagagcaagccgagactccatttcaaaagagtagtagttggatctaccagcgggaatcttaatagggatgtgagatgtgtttagatctcaaagcctgaccctgagtcttaaaatcccaggtcagatcctaagcagtcccagagagctccacctggtgtgcatctgtgccagtgtcttggggtggggcagctgcatgctcaggtggaatccggggctgagttcaagtttaatccactttatgaagaggaggcagagtgaggcataactcctcatccaggggagtggaagtactgtggaaggaagctctgttttgtacctactacgtgctggccctggcctcactgtgcagaactctccacattggaaaggatccccccagaccagagaggcgtaaggagggggctggtgctttccagtgttgaactgttcatctgtcctcacacccaccatcgggtcctacagcaaatttgtttgattttctgcaaaacacccagaatctatccactccccgtcctcccattgccaccacgctggtcccagccaccccactttctccctgcatccctacaacagctgccacagtggtctcgaggcttttgcccccagccccccacacacacatcagtgtcctcaacctggtggctgtagtgaccttatgaaaacacgcactggccgggcacggtggctcacgcctgtcatcccagcactttgggaggccgaggcaggcagatcacctgaggtcaggagttcgagaccagcctggccaacatggtgaaatcctgtctctactaaaaatacaaaaattagccaggtgtggtggcgagtgcctgtaattccagctacttgggagactgaggcataagaattgcttgaactgggaggtggaggttgcagtgagccaagatcacgccactgcactccagcctgggtgacagagtgagtgactgatggtgaggacacgggctctgaagccacactgcttgggcagagatgccactcattctgtttgttttctcatctgtcaaaagggcctgatggtagtaccttcctcatcaaaacgttccagtaaggggcccagtgaggtggcttcctcctctggtccactgaatgcgtgcgtggcgggcatttaaagcagtgtcaggtatacgtagttacgtgtttgcagtggcgaggtggactgttgagttttaaagagtctactgggcgcaggcactgaccagagaggaagtctgcagccttgatggatgaaattcgtgttccacccaccagccagaccctactggcagcagcccatggcgggggtattaatggcctgggcatcccctctggcgcgtctccagactgccgtggtgtgggcccaacagcagtctcgttagcaggctggcaggtgccggttcccacgtgctggccgcctgtggcccaccctctgctccctggcacacagcctaggaaagagagtctggtggccctgggtcatccccagctgagtttgccaaatgcccacatggcagcccctgcctagggtcactctgcaaggcaggtggctcagctccagccagagaagacaggctgcatctgccgcccttcctttctctaaaggacaaatgtgtcctgtgcaatgactttggtattacacccagaaacagatccccactctgtccttactgactgggtcaacttggcaagtcatgtcaaccccttgagcctcagtttcctcacctgtgaaatggagctaggaataggtagttgtgggtccacagctttgcaggcatgactaggggcaggtcaagaatgcggacttcctgccccactttgaaggtggtagaagctgcagttagaagtttactccaggccaaaaggggcatcacaaaacctgtgaggatgggccatcagaaagtcccatgacctgatgggcggagcaggccctgtgtccttaagaaaaggtggagttcttgccctgccacccctgacaccagcaaagccactgctcaagtatctgtggatgatggatggcagcggggcaggttagaccggggattctcaaccaagtgggtctttttgttttgtgttttttcagacagtcttgctctgtcacccagcctggagtgcagtggtgtgatcttggctcactgcaaccttctctgcctgggttcaggcgattctcctgcctcagccttcagagtagctgggattataggcacctgctaccacacccggctaatttttgtatgtctggtagagccaggggttcaccttgttgtccaggctggtctcgaactcctgacctcaagtgattcacctgcctccgcctcccaaagcactgggattacaggcatgagccactgcacccggcccaactaggtggctttgaccccctgggggattaatggcagtgtcacaagtctggtggcggtagaaggaggatgttattggcatctagtgaagaagaggccaggggcgctgctgaacgtcctacgatgtgcaggacatgtccccacagcacagaactatctggccccacgtgtcaataaggttcagaaagcctgggggattgccttctgtgcttccacgaacacatatccatgtattatgtcattcttgcggcaatgccacgaggtcagtgagactccctgactagcatacataatgttaggatctagggagttgtctaatgtctcacgctgcccttcccagcgatctatgtgtggccttaggcttggctactttagacttagtccctcttttccggtgcctgcagctggtttggtgagtccagtattaatatactgaccgctgtcagaaagaggagtgaggaggctgggcatgatggttcacgcctgtaatcccagcacttttggaggccgaggtgggcagatcacctgaggtcaggagttcaagaccaacctggccaacatggtgaaaccccgtctctagtaaaaatacaaaaataattagccaggtgtggtggtgggtgcctataatcccagctacccggcaggctgtagcaggagaatcgcttgaacctgggaggcagaggttgcagtgagccgagatcttgccactgcactttagcctaggtgacagagtaagactctgtctcaaaaaacaaaaaaagaaatgtgtgaggaatgcaacaagctgtgcattgaccacccttggttacagcaagttctccacgctcagccgggtccagcctttggctgtcagcagcatctggagcggaactgtgaacagaaacactccaggtgttccgacgggtgctggggcgcccccagggagctggaatttggtttttagcaaccacatataggaaatgaacccgccagccacagtatctcacgcctgtaatcccagcactttgggaagctaaggccagcggatcacctgaggtcaggagtttgagaccagcctggccaacatggtgaaaccccgtctctactaaaaatacaaaaatcagctgggcgtggtggtgggcgcctgtaatcccagctgctccagaggctgaggtgggagaatcgcttgagcccgggaggtggaggttgcagtgagtcaagattgcacccctgcactccggcttgggtgacagagtgagactttgtctcggacaaaaaaaaaaaaaaaaaaaaaaagaaccaagtcctcgggcaaattctcccattgagggctgtgaagtcttggctcctctgttgtttgttttggaaaccaaacttgcatatttgactttctcatgcgtggagaggacccatgcttggcatgggggggcacctggtttttgtgtccttggagctcatctctggtgggggaggaggagcagcaggagatgcgagggctgtagttctcagtcctggccgcacattggaatcctatgggggagctttaaaattatacaccaaactcggccaggtgcggtagctcacgcctgttatcccaacactttgggaggccgaggagggtggatcacatgaggccaggagttcaagaccagcctggccaatatgctgaaacctcgtatctaataaaaattacacaagttagccaggcatggtggcgcacgcctgtaatctcagctgcacgggaggctgaggcaggagaattgcttgaacccaggatgtggaggttgcagtgagctgagattgagccactgcactccagcctgagcaacagagtgagactctgtctcaaaaaaaaaaaaaaaaaaaatacacacacacacacacacacacacacacacaactggagaacagagcatggtcactgggggcaggagcgagagtgatgggtgtggtcggaaaatggtggtggctattccgtatcctcaccctggtgtggattcatgagcctacatgtgtgataaaactgcatgggacaaaataaacacacacacacacaggagtacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtctgtcgctaagtctctgggcagactgctcggccgcgatcctgccggagaagaggcggggctgggctggtcgggctgggctggtccggctgggattcgagctccgggatcgggaggccccgggcaaggtccagctgcgcggcgggagtgaggccacgggaggtgaaaacaggcgaggtgggggatgggggaagagaggcgctcggggagctgggacgggcaccgggttggggggtcccggaacccctgaaagttcagtgacacctccatagttccctcttccccctgcaacaagaatcactccagacttcctaaacactttggacccagcaatttccaggagttcatcctgatgagagaactgaaaggtgtgcacacgttagtaacaaggaggcctggtgaccgcctaagcgtccaatcgcggggaccaccgggtcgaggccgagaggatggagaccgcgtcacaggcacctcgctgctggaatggagggtggtggggagaacttagaagattatgcaatgggctggcagggctatacccagccgccctggtaagcagaaactcaagaaacctctagggtcctgttttctggtcgtatgatcccaggagtgcacatgggcccctcgggtgtctgaacagaagggcataggagggagggccgcagccctgcagtcttactctgctggtgtagcggtcacctgccaactcccaccccaccctgcaccgcgggctcctgagtcggcagattaagcattttataaattctattttaaatacgtgttttaaacttgtcagatatttgtcttcatttcagtccctgcgcctctacctcttgctgtggtcgcttatttaacactggggggctacgttctgctaagtcccagggagagactgttcctaatatccgagggagatattattcctaatatcacgctgggtgaacaccacgtgtgtacagcctctgatacgattggtaatatccaagggagatattatcctaacatcccagtgggtgaacaccatgtgtgtaaacgctgtggtattattagaaatatccaagggagatattactcctaatatcacagtgggtgtacatcctgtgatattattcgtaatatctgaaggagattttactcctaatatcacagtgggagtacacactgtgatattatttgtaatatccgagggagattttactcctaatatcacagtaggtgtacaacctgtgatattattcataatatgctagagatatattactccaaatctcatggtgggtgtacactctgtcatagaattcgtgatatcctagggagttattaccgctaatatcacagtgagagtacaccctgtgatattattcatactatcctagaaagatattacttttaatatcacagagggtgtacaccctgtgatattattcataatattctatgaagatataactcctgatataaccgtaggtgtataccctgtgatattatttgttatatcctagggagatactacacctaataccacagtgggtgtacaccctgtgatatgatttgtaatatcctagggagatataactcctaatatcacagagggagtacaccctgtaatattattcataatatcctagaaagataatactttcaatatcacagtgggtgtacactctgtgataatattcgtaatttcctagggagatactactcctaatatcaccttgagtgtacactgcgtgatattattcgtaatatcgtagggagctattgcttttaatttcacagtgggtgtataccctatgatattattcataatatcttaagaaggtagtactcctaaaatcacagtgcctgtacacactgtgatattattcataatattctagggagatgttactcctaatctcatagtgggtgtacaccttgtgatactatttgtaatgttctagaaagatattccttttaatatcacagtgggtgtacaccctgtgatatgattcgaaatattctagggcgatattactcctaatatcccagtgaatttacaccatgcgtgtacacgctgtgacctcccagaaagatatgactcctaatatcacagtgggggtacaccctgtgctattatttgtaataccctatggatatcataatatcacaatgaacgtacaccattgtgtacatgctgtgatattatttgtaatatttttgggtgatattacccctaatgtcacagtgcgtgtacatcttttgatattatttgtaatattctgtggagatattgcccctaatatcacagtgggtgtatactctttgatactattcgtaacatcctggaagatattatccatattgtcacggtgggtgtacaccctgtgatattattcgttatattctggggatatactattacccctaatatactgtgggtgtaccccctgtgatattattcactatatcttggagatataatattacccctaatatcacagtgggtgtatactttgtgatattattcattatatcctgaagagatattatttcctttaatatcacagtgcatgtacaccttgtgatattatttgttatatcctggggagatactactatattactcctagtatcacagtggctgtacgccttgtgatactattcattatatcctggggagatattattactcctaatatcacagtaagtgtataccctgtgatattattcataatatcctgggagatattacccatattgtcacagtgggtgtacatcctgtaatattatttgtaatatcctggggagatattattactcctaatagcacagtgggtgtacaccctgtgatattattggttatatcctggggaggtattattattcctaatatcacagtgggtgaacattctgtaatattattcattatattttggggagatattaattcctctaatatcacagtgggtgtacaccctgtgatattattcattatatcctgggaagatattaatccctctaatatcacagtgggtgtacaccctgtaatattattcattatatcctgggaagatattatttcctctaatatcacagtgggtgtacaccctgtgatattatttgttgtatcctggggagatattattatgtctcatatcacaatgggtgaacaccctgtgatagtattcgttatatttggggaagatgttattacccctaatatcacagtggtgtacactctgtgatattattcattatgtagtggggagatagtattacccataatatcacagtggatgtacaccctgtcatattatttgttatatccttgagaaatattattattcctcttatcacagtgggtgtacaccctgtgatattattcgttacatcctagggagatattgttacccataatatcacagtggatgtacaccctgtcatattattcgttatatccttgagagatgttactacccctaatatcacagtgggtgtataccctgtgatattattcatcaaattttctggagatattattacccataatatcacagtgtgtgtacccactgtgacagtattgattatatcttggggcgatattactcttaatttcacagtggctgtatccctgtgtttacaccctgtgatgttattcataatattttagggagatattactcctaatatcacagtcagtgtataccatgtttgtacaccctatgatattatttgtaatattttagggagatattactcctaatatcgttgtgggtgtacagcatgtttgtaaacactgtgatattattcataatatctgagagagatattactgccaatatcacagtgggtgtacaccctgtacaccgtgtgatacgattcataatatccgagggagatattactcccagtatcacagtgggttaacaccctgtggtattattcataatattcgagggagatattactctcaatatcacagtggatgtacaccctgtgatattatttgcaatatccgagggaaacattactgctaatatcacagtgggagtacaccctgtgatattatttgttttatcctggagacatattattcctattatcacagtggttgtacaccctgtgatattcttcgctatattcatggaagatgttattacccctaatatcacagttggtgtacaccctgtgatattattcgttatatcctggggagatattgttacccctagtatcacagtgggtgtacgccctgtcatattatccattacatcatgggaagatattattacatctaatatcactgtgggtgtacaccctgtgatattatttattatatcctggtgagatgttattactgctaatatcacagggtgtgtcaaattttctggagatattattacccttaatatcacagtgggtgtgcaccctgtgtgtacactctgtaatattattcgtaatattttagggagatattactactaatatcacagtgggtgtacaccctgaggagatattacttcctctgatatcacagtgggtgtacaccctctcatattattcgttatgtgctaagtagatattattacccctaatatcacagtgggtgtacaccctgtgatgttattccttatatcccaagaagatattattataactaatatcacagtgggtgtacaccctatgatattatctgttatatactggggggatattatttgtaatattttagggagatactactcctaatatcatagtgggtgtactcatattttacagatatattacttttaatatcacagtgggtgtacaccctgtgtgtacaccctgtaatattattagtaatattttagggagatattactcctaatatcatagtgggtgtacaccatgtttgtaaaccctaggatattattcataatatccgagggagatattactcccaatatcacggtgggtttacaccctatgatattatttgtaatatctgaggcaggtattactctccatatcacagtgagtgtacaccctcctatattattcataacatccgagggagatattacttccaatatcaaagtgggtgtgataatatctgagggagatattattcctaatatccgtgggagatattattcctaatatctcagtggttgtaccgcgtcacagtgggtgtgcactgtgtgatattattcatagtatccaagggagattttactcctgatatcacagtgagtgtacaccctgtgatattattctaatacccaagggagagctttctcctaatatcacagtgggtgtacactctgtgatatttttcataatatccgagggagataggatggagaccacgtcacagtcccctcactgctggaatggacactgtctacccgtggagtggtggggagaacttagtgagattatgcaagcgtttagcacactgccagatatacattaaatgctcagaagacttagcttttattattactgtcataattgaggccatgggttactaaccagtggtttaaaatgccattgcagctgggcacggtggctcatgcctgtaatcccagcactttgggaggctgatgagggcggatcacttgaggtcaggagtttgtgaccagcctggcaaacatagtgaaaccccgtttctactaaaaatacaaaaattagctgggtgttttggtgcgtgcctgtagtttcagcttctcaggaggttgaggcaggagaatcgcttgaacctgggaggcgaaggttgcggtgagccaagattgtgccactgcactccagcctgggtgacagagcgagactctgtctcagaacaagcaaacaaaatgccattgaagacatatatgaatatgaaaaggtgcttgctaaatgatgattgaataaaagagattataatataaaataggctttggtttttttaaagcaaaaaagaaaaggatatgcctaaattagggaacatggagaagaaggccaaggcatttaccttcctctcttgagtctttttctctctccgtctctgttttttttttttttttttttgagtcagggtcttgctctgtcacccaggctggagtgcagtagtgccatcatggctcactgcagccttgacctcctgagctcaagcaaccttccacctcagcctctccggagtatctgggactacaggcacacaccaccaagcctggctaatttttaaatttttttgtggagacttgtctcactttgttgcccaagctgctttggaactcctggcctcaagccatcctcttgcctaggcctcccaaagtgctgcgattacaggcgtgagccaccatgcccagctctctcttgggtcttaaagcaaagtgtcaaagacccagccaccacttcttagaaatgactcgatgtcatactagcataaatgcatcgataaaaagatggaaatgtggtaacacagtgatcttggggaatcctagttttcttttccaatttctttgttgttgcagtgagcaagtacttgtttcaagataggaatgaaatattcggctcttttagacagacaagcacaggtgctcagtttgggagaagaattaaaatcctctgcactctccatgctgccttgctaattcttggggtcctgtcctcatcttctactcttgccttctgcagggaccccacagtgtgttttccccgatctttttgtatcactctaaatccagtattgggcccagggagcaccccctcccctgcccccttcagctgtcctcctgcctgagtcttctggaagcttcgggacagaaagaacccaaggatttgtcatgaagctcagtgtggcaggtctactgtttccatgtaaatcatgtctgcttatctgagctggttttggtggaaactgatggaaattatggggaagctaaatccctgtctctctgcaagccactccccaatcccacccccatgaattggcattgtcacagtcctggtgcttcatttctttctatatttgaagatgaatttgagggaaatagtcagaaagtcaagaagaacacagcagaaatcaattggggtgagtccagaacaaaacttggggatcccacttcctgctttttttttttttttgagatggagtctcactctgtcgcccaggctggagtgcagcggcaagacctcagctcactgcaacctgtggctccctggttcaagtgattctcctgcctcagcctcctgagtagctgggattagaggcatgcgccaccacacctagctaatttttgtatttttagtagagacagggttttgccatgttggccaatttggtctcgaactcctgacctcaaatgatctgcccacctcggactcccaacatgttcatattacagtagtaagccacggcttctggccccaattcctgctctctagctccgggaaaacctgtggctgcatgcagagtcttagacaacttccttttcctctctgggcctcagtttcccattctgtaagatgagaggtttccataggcctacactttctaattggtggctttcaatcctctggtgatttgcataaaaggcatctatttcaattgtggttataaataacaaaccccaataaatagacgaattatttaaatggtttctcattatcactgaatagttgagagtctactgtatttgagtgaaaatgcagcacgagaaactgaaatcagatgcgctcatgattatgaccctgaggtcaatgtgtcattcccttcattccctccttgcccccatgaaggtttgactactgtatggtttgaacctgtgcttcttagttgtttattgcttaagttttagccacaacggcaaattgcagcgggaaattcagtcttactttgtcatttggaaacaaaatacaaaacctatcaaaataaagcactagcttttttttttttgagacaaaatggaagaaatcctaatattaggttagaaaagcaattttttggtgtttttaaaattttatttatttatttttttgagacagagtcttgctctgtcgcccaggctggagtgcagtggtgcgatctcggctaaccgcaagctccgcctcccaggttcacgccattctcctgcctcagcctcccgagtagctggtactacaggcgcccgccaccacgcccggctaagtgtttatatttttagtagagacggggtttcactgtgttagccaggatggtctcgatctcgtggcctcatgatctgccagccttggcctcccaaagtgctgggattacaggcgtgagccactgtgcccggcctctttggtgtgtattttgatgtggtgactggtagttaaattcagtgtacatatgaattcactcttgggacaaaatatgctggatttgagcttgttttcaggcaaatcatgtttcatcttgcagagctaattcaaagtatactgactgcatgcacttcttgcttaggggaagaaaactcatcaaaatttgtttctaggcatatgttattagagctaggattaaaataaatcttacatactttctttaatatgctaacattaacacgtttcgcttaaaaaagtatcgatcatttatcatggaaaaatacaccagcttacacaaattcctaaagcgtttttcgtgtgtgtgtgtgtgtgtgtgtgtgcgtgtgtgtgtgtagagatggggtttcgccatattgcccaggctggtctcgaactcctgggttcaagcgatccacccacctcagcctcccaaagtgctgggattacaggcgtgagccacacacccggccctaaagctttttgtgagattatatattttacctgcgaaatatatgggtcagaaagatttgagaaagttgttagataattccaccaacgaaatctcccgtcctttccagctgtgatggtgaattctaaagtagaattcatctttggagcttctccctgtaggcatgcaccttgcgttgcacctgccagatgtcgcgcggagtcctccaggcctctagaaggcagagatggtctcgtttccttgccgagcatgcgccttagttctctcttctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagatactgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaacaatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaagccagccgatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggtaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtcgggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccatgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaacctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagacggagtctcgctctgttgccaagactggagtgcagtggcatgattttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaatcagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtttcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcatttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggctactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaataaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacagggaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcatacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaaatgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgcaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcatggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacatttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatgtttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcacaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgttgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatattttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactccacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttcctgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagagctgttttaaaatttgaatcatttcccactttgcttaaaatctttcagtggcttctcgctctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgtgagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagacgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccatttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcattgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtaagctctcttgtgcgtttccctacagtgtcctctgttttgtggggataggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttggatggatggatggatggatggatggatggatggatggatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgcgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcagtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattacatcattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttcttttttttttttttgagatggagtctcaccctgtcacgcaggatggagtgcagtgccgtgatctcggctcactgcaacctcctccttgtgggttcaagtgattttcccacctcagcctgtagctgggactacaggcatacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccacgagggatccaccccaaagatccgatcatctcacagcaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcgcttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattcccctggtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaacaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacctacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacatggtgattggtatcctttgggtcttttttcaggcacgtgtgcgcatgcatgtataaatataaatagacatttattttaataattcaaaactgacactgttttgtacattgttttgtaatccatgctcttcaatgaagaatttatcacaaatctgttcctcatcatcaaatctttcttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaatttttttttttgtgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgcgatgatttatttaaccaaggcctactgttgggcatgatcgactcttgcactttgaacatatcaccccatgctttcctgctaagaagtccacttttaaaaatgccttgtaatttttaaaaattcctctattttaacattctgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaagctgtgcctgctggggcttggattcccgagcagggccaagtgttgaatgaagagagcgcccactctgtgccaccccgtacagggccctcacaggttgatcctcacaacaagccttcaagcaggtgtgccattcctcccattttcacagaagcccagaaagattgagtcacttactgagtgttagcagaaccaggactcaagtgaggcagtttgtctcaagccacatggtttccacctcgttctgccctccgcgtgatgagtggctcagcattgcatgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactcttaattcctgctgaattaaacttttatttatttattcattattatttttttctgagacagagtcttgctttgttgcccctgctggagtgcagtggcacgatcttggcccactgcaacctctgcgtcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgtgctgttccagtgcattgcttttctccaaaatggggcaattggccaaatgctgtctacccagcaaaagggagggcacaccacttccctagggtccagccagggtgtggcacttaccgcttctgttcctgtaccattggccaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattttcccaattttaaatgttagccacaaatgcagtgtttttttaagaaaaccacacactttggccaaacaaaatgcctacgtcggccgggtgaggcttaaaggttgccggcttgcatcagagatccagaggaagtcacagcattttaacagctaaacttaatcctcacaggaagtcatcaagtgaattaagtgatattgaaggaggggacacatccatccatccgacatttattgagtgccacataggacaggcatgggtatgtgaggatgagtagggtagacaacactctacagcgagctggaagaggccagggaggccccgtctgccttgttcttcgtaccccaatgcttggcacttggtgggcattcagtaaggaatgaatgaacgcacgcacagaggaatgaatagatgggcacacagtgtgtgccctcacagcacatggcccatcactgggtagaaggcaagtcagtaagtagacaggggtaatgcagggagccgagggcctccaggtggaggaacatggaggaccacaggagcacagagcagagttctcatcccactggagagcttagggaactttctggatgtgatgcgtgagcagagtccaaaaggacaaaacagagagagggaaaacaaggtggaagttcttgttaggtgccactgccaccccagggggtcagcttgggggactccctggctcttgggggccaaccgcagagctgccctgttcccacctatcagctagcttggtgttggcaccgtggaaggaaagtgaacagtgttggagatctgggacagatgtgatattaatacaggatccatttcttggagtgttttccaactcttattccaagtggacacccagaaacatcccttttaaatgttaatggggtttttattgacggtataaaggttaagagcttgcgaaagatacaattgtcagtacactccttccagttccggaggccgccagtaagtggcagtctttccctgtcgctggctgcaggtcacccttggcctcggtggaacttgtgtgggtcattctcagtccatttgaaagttgggcctgttcggttgtgtataattttctgttcatcatttttctggcaatctcaggacagaagtcctctgatcctcctgtgagaagtaaacattaatgttattagattctttttttttttttttgagtttcgctcttgtggcccaggctggagtgcagtggcgtgatctcggctcactgcaacctctgcctcccggtttcaagcgatttcctgcctcagcctcccgagtagctgggattacaggtgcccaccaccacgctcgcctaattttttgtatttttagtagatacggggtttcaccatgttgtccaggctggtcttgaactccctacctcaggtgattcatcaaccttggcctcccaaagtgctgggattacaggcgtgagccaccgcacccgggctgttattagacttggaatgggacaaaagtcatatgagacagacttgtttgctgaggtatttaaaaaacaaaatggtctaagatggcagattcttggggaactctgctctgtgcacatttctgcctattaaagtggccgtaaaaacaaccataaatccttgatgaggacacctcaggagctttaggacggtgccattcttttttaattaaaagctttttatttgatttgatttttctgtagagacagggtctcggctatgttgaccaggctggtcttgaactcttggccttaagtgatccttctgcctcaacctcccaaagtgctgagattataggcatgagtcaccacacctggccagggcagtgccattctaaggcaacggcttcaactcggtcttcttttctggggttacaggagatgggaagggccgaaggtagcatgagaacgtgtgtgtgtgtgtgtttgtgtgtgtgtgtgtgtgtttgtgcatgtgtatgtggaaggactggtgagatggctggaggaagaggcagtccttctgcttaactctaatggcctaaatgtgagaaacaaagattcaggaaataaggaaaaagcaaatgagtgattgcctctctggatcaagcacaccagcaggcacaaccagcctttcttgagctactgtgtgccgggcgctgtgccgtgcccttgcatgcatgtggatgcttcatgagttcatgaagtaggtatgcttccagccccatttttcagagaaagaaactgaggctgaacaatcttgcagctgtcaagtggcagagcaggggtttgaacccaggtccaagagttcttaaccaccatgttttcctgcccttgatgtatgaaatgagatgatgtagtcacatgccagcttgtctagggatgactcagaggtttagagatggatgtcacgtggatgttgtacaggagaggcaggtataagctgtagtaaagttaggaaaggcacagtgacgtggagcactgtgtgcagtggacggggtcatggctgggggtgagaatggtggaggaccttcgattatttcatcagcgttgtttctgtaaccaaagagctgcatgaccaaaccctgagatctagttccttaataggaacaattattcggcacgattccctttacttaaaagcaggggccgtcctaagggaggagttggaaagagtttgggggataaggtttgcttggttgccttctgtttaggctgatgttcagtgggggtcaaaggctgtgtgtccagtccctggcatgtggcgggtgtttgtggtacacagccagcctcaggatggcccccagggatgcacactgcctttgtgtgtggtcccctcccacactgaatcaggctggctctgtgcgaccagtgggaagtggtggaagtgagtgatgatgtgtgacttctcgggctaggtcgtaacaggcattgcactttggctctcgggaagccaactgccttgcgtgagggtgctcaggcagcctcgtggggaggggtgaggcccctggcccccagcatgtacagcttgccaccacgtgagtgagccagcttggaagcgaatttccccgccccggtcaagccttctggtgagtgcaactgcagatgacatctgacttccaccactcaagagaccccaggtcagtgctgcccagctgagctcttcccaggttctttatgtcccccgaaaatgagctgttttaagtttagaaaacttaaaaacacagtgacaatgaagcacagatatgcattacatacagtcccaaatcagtaatgacttcaagctgtgtcctctctttccaagaaagacaaagcagagaacaaagttcaacctacagtgtcttcccaaattcttgacccacgggatctgtgaatatcttatacgactgaattaagcctctaagttttggggtaactcatgcaacattaggtaactggaatagtgctcaataaatgtctgtcacatgaatgggcagtgaccatggatgcatttctagttgtgtattagttaaggctctcttggtttcaagtaacagaaatccaactccaactagcttgagcaaaatggggcattcctctggtcaagtaacggagaaatccaagagtctctggcttcatgcatagcgggacccagtctcaatttccacctcctggctctgcttcccttgatgccaactttcaggaatcagctttctgaaagaccactctgctagaaacagacaggcccatcctttcaaccaggtccaggactgtttgctcagtcactgctctcagaggcaggggcagaggcagatgccgggcacacatccacagaagtggagatggcaggaaactgagagtggagtgctggaaagctggcttttgcctatgggttccgcttctgacatcatccggcaatgtcaggctttacattgcccccatctgcagacccagcagaaggacagcttccatcccaccacatcaatatgccagtcctggggcgggggaaggacttatgggcaacctttgcagaatcactggggcctggccgcacatgagccatgcccacgctcatgtgacaggcggcccctgtgcctggggtgctgtattacccagaggaataagtgatcctgggtgggcaaaagcaacagaagagaagtcagctccacttccttccaaaacttgagaaggcctggtcaaaatcaccctccaggcccggtgtggtggctcatgcctgtaatcccagcactttgggaggttgagatgggcagatcatgaggtcaagagatcgagaccatcctggccaatatggtgaaaccccgtctctactaaaactacaaaaattagctaggtgtggtggtgggcgcctgtagtcccagccactcgataggctgacaggagaatcacttgatccagggagtcggaggttgcagtgagccgagatcgcaccattgcactctagcctggcgacagagtgagactaaaaaaaaaaaaaaagaaaaaagaaaaaaatcagcctccatttttggctttctctttcattagaaaaatgaacctgactttatgaccatgacaatgaaatgcctagagaagggagcactcattttccagtgggcctactgtgtgctggggtggcgagactcttcctgccctggaacttggtgaggtcaggagggaagatattatatgactgccttcctctgtactttttcagtgggggcaggtgtttatgcttgatgatgcaatggtgagatcttggttggaatatgaacttttctttctttttttttttttagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaatctttgtagagatgagctctcactaggttgcccaggctggtcttgaactcctgagctcaagcaatcctcccaccttgggctccctaagtgttgggattacaggcaagagtcaccacgcccagccaggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgctttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcatggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatgtaagtagttgtggcaaagaccaggtagcctaaaaagcctaaaatacttgctatctgggtctttacagaagacattttgttgttgttgttgttgtttttgagatggggtctttctctgtcacccaggctggagtgcagtggtgtgatctcagctcactgcaacctccgcctcttgggttcaaatgattatcgtgcctcagcctccctagtagctgggattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccactgcgcctggcctagaaaatgttttctaacctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttgttggataatgccaggcgttacgaagaaaagaagcagaacaaggcaatgtgacagaggatgattggtatcatggaaggtctctctgaggaggcagcatctgagctgagacctgaggaggggaagggccagttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcgtgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggcgaggagggccctgcccaagagacagagaggaagtggcccgtgaggtagggggaagtccaggagaggacagtgtggtgaatacctaatgctttactcattcactggtgaatgaatggatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacattactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgctaaatgaaacaaaatgaaactgctgcagtgatggggcatctcagagggacacaggagccagtggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttttatttaattttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaatttatatagctattccatcgtcaaggaggtggagcggacttcccacatcctaagtgtgggctgtgcatagtgactctcttccaaagagtacagtgtgaaaagagaggagagagtaactttacagtggagaacacggacagactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctggatttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcggcacagcggccctgctaaataaggaacgcctggagccgcggttggcacggccccggggagccgaaaaaccccgggtctggagacagacgtccccacccgggggctctgcggacgccagcgggggcggggcgcggaggccgcgctcagctgggaggacaaacagtcgctaattggagaggaattgggattcggcctggggctgcggggtacccggagagatggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggctttctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggaacccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaaggatgctgccgagaggtggtggcttttggaaaagatggcgtactgcaaaacgtgctgctctgcatggctcgaagcttcgtggggagacgtgggcagagccgtggctgactcacagaccccccaccccagagcctgccctgccctccctgccccgacccttcccctcctgacccatgtgttttttgtttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaataccgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagtgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatacttttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtatatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtcttgatctcttgatctcatgatccacccaccttggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctccgctgtgctccctggtagcctggtagtgagcctgcttctcacacagtcatacctggttgtggtcccacagtgggaccaccctgttgggttcagaacaggagatgggggcccctcgagtctgtgtgggggctgtagacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggcccccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgttctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcaggacggcctctcagccccgcacgagcccgtggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagtgcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcctttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagcgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccacacatacgtctgttcccacacgcatccccccaggggccctcagtgagcattgcctgcctcctgccagggtccagctgggtccagtacaccagaacgcacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgctctcaccaccaaggtgcacttcgaatgcatgggtgagtgcaggcctgcgtagggggagcagcgggatcccccgactctgtgaggtcacggagccctcctgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccaggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctcatcccgctgagcccctccactcctcccccagcccctccatcccctcacccctcccctcctccttcctcccctccctctcctctcccccttctctctccttccctctcctctccccccttttctccacttccctctcctctctcccttctgccctcctccttctctcatgtgaagaggtgccttgtgtggtcagtgggctgcatcacgtgttccccaggtggaggccctgggtcatgcagagccacaaaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatcccccttatccccttcccctccctttcaccctgctcctcttcttctcccctttctcttttctctacccttttccttcctttttcctccctctccccatcatccccctcatcttcgtcctcatccccatccccttccccctccccctccaccactctctctccagcttccctcttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcgtcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggtgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggtgtggacaggtgtgcagtgcgggtcactggttgtggtgtggactgaggcgtgtgcagccatgtttgcatgttacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcatgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcggagctgtttcactcgcatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcatgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccagcaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactccagcctgggtgacagagcgagactccatctaaaaaaaaaaaaaatgaaatttaaaactctgttccttagctgcaccagtctgctgtcaaccgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgatatagataaggacatcatcactcggtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggtttgtgaaggttccagagaggacctggccttgggaggagcgtgggggactgagaagggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatcgggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtccggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatgacaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggcctggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagtgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctcccgagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatatttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggttatccgcctgcctcggcctcccaaagtgctgggattacaggagtgagccaccatgccagcctcatgtcattcttgtgtgttgtgtgtgtgtgtgtgtgtgtgtgtgtgacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaactgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggtgtgagccaccacacccaggctttttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcagggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgctgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgatttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcactgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcctggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagactttgaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattacctcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgcagtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgcgactacaggcatgtgccaccacgcctgggtaatttttgtatttttagtagagacagggtttagtagagaccatggtgaaaccccgtctctattaaacaaatctctactaaccccatctctacaaaaatcagctgggcgtggtagtgcacacctgtaattctagctacttgggaggctgaggcacgagaatcatttgcatcttggaggcagagtttgcagtgagctgacatcgcaccactgcgctccagccgggatgacagaacaagaccctgtctcaaaaaaaagaaaaaggaacaaacaacagcaacgacaacaaaaaaacctctgtgtcaatcacagccttcaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgcacgcgcgtgtgtgtgtgcacgcgcgtgtgtgtgtgtgtttaatatagagacagggtctcactctgttgcctaggctcgtttcaaactcctgggctccagtgattctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatcttagctccctgtagccttgacctctctgggctcaagtgatttttctctcctctacctcccgagtacttgggaccacaggcgcatgccgccatgcctggctaatgtgtatttttttgtagatacggggtctcactgtgttgcccagggtggtttcaaaatcctgggcccaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcctggcttggtttccccagatgagtgttcatttgggtcttccatcagaaaggcccctcctgacctctgggagtggggagctcaagggtgggaggccttagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcactggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggccaccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgtgttggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggtgcctgcccccaccccccgaggggccataggttgggagatctctgaagcagtggggcagagcctgtggctggggagtctcaggaggagggaggtgggagctgggccggccctggtgagcaggtggcgccggccggtggggccgttcctgtcagctctgcagatgcagaggtggacacgagctgggggcagcctccggacactcctgggcacgccatacgggaggtggcctgcacggggatccctgccagtgcccacaggcctcgtgggtgggtgctgctgtgagcctgggctggtgggccctgctctccgggctctgagcctcagtttccccatctggaaagggggacagtgacggggctcccagtgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgctgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgcagggacccctgatgcctctggcacggcagtacggcctctcagccccgcatgagcccgtggaggtagtcggccccccacgttctaaaacctgccctcctgcctgcccctggaggcctcgcctgccctgcccactgtgggtctccccaaaaaacttgggggccttaatgttgcttgtgcccagtgaagatggttgggaaaatccagagtgcagagaggaaagcgtttactcacattacccccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccgtgggcgaatgagggccccaacaccctcccctcctcgcagggaccccggagaacggcagcgagcctgagagcaggtccccggacaacaggacccagctggcccccgcgtgcatgccagggggacgctggtgccctggagccaacatctgcttgccgctggacgcctcctgccaccccaggcctgcgccaatggctgcacgtcaggggccagggctactcggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgccaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcatgaaatgaatttaaaactctgctccctgacctcacacgagcccccgtgagtctctcacgccctctgctgtgttctcacctggctaaagcgagtggcttttgaggtggagtctgaacccctgatgggaaactgcgggctgcccgcggtgccaccatgctgggtacatgggggacagggctgtctccgtcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctcccatggcatgcagagccccggccacctcctctcctctgtgccccgcgtgggactctccagcctgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggaggggaggggatggggtggggcggggcgggctccaccttcacctctgcttcatgctgcccgaggacgctgccatggctgtgggtgagtggagggagggacgctaagcagggccaggcctctcacctgccacctgggcccactgatgcctatccctgcagctgacggcctccaaccacgtgagcaacgtcaccgtgaactacaacatcaccgtggagcggatgaacaggatgcagggcctgcgggtctccacagtgccggccgtgctgtcccccaatgccacgctggcactgacggcgggcgtgctggtggactcggccgtggaggtggccttcctgtgagtgactcgggggccggtttggggtgggcaccaggctcttgtcccggccccagcctcagccgagggaccccacatcagggggttgcttttctgagcctcggtttccctatctgttgggaggtactgggtgcacaggagccctgaggctgcacgggagccgggagaggcctcagcacagccgggtgggccctgaatggaggcctggggcgtgactgcagagtggagcctcagctgggtcccaagcaccccctgcccccccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacgcacacctacgctgccccaggtgagggatgagggggtgagggggccactgcctttcaggctctgagcacggggcacccccagtcccccagtcaagctgccccccttcctccccaacagccctcactgtgacctcacctgggctgatggcttaggtccctactggggtgagggaggggccaggcgtggggggagtggacagggaagctgggccccctgaactgccccccgccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccgtgctggcatctaatgccttcgagaaccggacgcagcaggtgcctgtgagcgtgcgcgcctccctgccctccgaggctgtgggtgtgagtgacggcgtcctggtggccggccggcccgtcaccttctacccgcatctgctgccctcgcctgggggtgttctttacacgtgggacttcggggacggctcccctgtcctgacccagagccagccggctgccaaccacacctatccctcgaggggcatctaccacgtgcgcctggaggtcaacaacacggtgagcggtgcggcggcccaggcggatgtgcgcgtctttgaggagctccgcgggctcagcgtggacatgagcctggccgtggagcagggcgcccccgtggtggtcagtgccgcggtgcagacgggcgacaacatcacgtggaccttcgacatgggggacggcaccgtgctgtcgggcccagaggccacagtggagcatgtgtacctgcgggcacagaactgcacagtgaccgtgggtgcggccagccccgccggccacctggcccggagcctgcacgtgctggtcttcgtcctggaggtgctgcgcgtcgagcccgccgcctgcatccccactcagcctgacgcgcggctcacggcctacgtcaccgggaacccggcccgctacctcttcgactggacctttggggatggctcctccaacacgaccatgcgggggtgcccgacggtgacacacaacttcacgcgtagcggcacgttccccctggcgctggtgctgtccagccgcgtgaacagggcgcgttacttcaccagcatctgcgtggagccagaggtgggcaacgtcaccctgcagccagagaggcagtttgtgcagctcggggacgaggcccggctggtggcatgtgcctggcccccgttcccctaccgctacacctgggactttggcaccgaagaagccgtccccgcccgtgtcgggggccctgaggtgacgttcatctaccgagacccaggctcctatcttgtgacagtcaccgcgtccaacaacatctccgctgccaatgactcagccctggtggaggtgcaggagcccgtgctggtcaccagcatcaaggtcaatggctcccttgggctggagctgcagtagccgtacctgttctctgctgtgggccgtgggcgccccgccagctacctgtgggatctgggggacggtgggcggctcgagggtccggaggtcacccacgcttacaacagcacaggtgacttcaccgttagggtggccggctgcaatgaggtgagccgcagcgaggcctggctcaatgtgacggtgaagcggcgcgtgcgggggctcatcgtcaatgccagctgcacggtggtgcccctgaatgggagcatgagcttcagcacctcgctggaggccggcagtgatgtgcgctattcctgggtgctctgtgaccgctgcacgcccatctctgggggtcctgccatctctttacaccttccgctccgtgggcaccttcaatatcatcgtcacagctgagaacgaggtgggctccgcccaggacagcatcttcgtctatgtcctgcagctcatagaggggctgcaggtggtgggcggtggccgctacttccccaccaaccacacggtacagctgcaggccgtggtcagggatggcaccaacatctacagctggactgcctggagggacaggggcccggccctggccggcagcggcaaaggcttctcgctcactgcgctcgaggccggcacctaccatgtgcagctgcgggccaccaacatgctgggcagcgcctgggctgactgcaccgtggacttcgtggagcctgtggggtggctgatggtggccgcctccccgaacccagctgccgtcaacacaagtgtcaccctcagtgccgagctggctggtggcagtggtgtcgtatacacttggtccttggaggaggggctgagctgggagacccccgagccatttaccacccacagcttccccacacccggcctgcacttggtcaccatgacggcagggaacccgctgggctcagccaacgccaccgtggaagtggatgtgcaggtgcctgtgagtggcctcagcatcagggccagcgagccgggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttcaacatccggctcaatgcctccaacgcagtcagctgggtctcagccacgtacaacctcacggtggaggagcccatcgtgggcctggtgctgtgggccagcagcaaggtggtggcgcccgggcagcttgtccattttcagatcctgctggctgccggctcagctgtcaccttccgcctgcaggtcggcggggccagccccgaagtgctccctgggccccgtttctcccacagcttcccccgcatcggagaccacgtggtgagcgtgcagggcaaaaaccacgtgagctgggcccaggcgcaggtgcgcatcgtggtgctggaggccgtgagcgggctgcaggtgcccaactgctgtgagcctggcatcgccatgggcactgagaggaacttcacagcccgcgtgcagcgcggctctcgggtcgcctacgcctggtacttctcgctgcagaaggtccggggcgactctctgttcatcctgtcgggccgcgacgtcacctacacgccgtggccgcggggctgttggagatccaggtgcgtgccttcaacgccctgggcagtgagaaccgcacgctggtgctggaggttcaggacgccgtccagtatgtggccctgcggagcggcccctgcttcaccaaccgcttggcgcagtttgaggccgccaccagccccagcccccggcgcgtggcctaccactgggactttggggatgggtccccagggcaggacacagataagcccagggccgagcactcctacctgaggcctggggactaccgcgtgcaggtgaacgcctccaacctggtgagctttttcgtggcgcaggccacggtgaccgtccaggtgctggcctgccgggagccggaggtggacgtggtcctgcccctgcaggtgctgatgcgacgatcacagcgcaactgcctggatgcctacgttgacctgcgcgactgtgtcacctaccagactgagtaccgctgggaggtgtaccgcaccgccagctgccagcggccggggtgcccggcgcgtgtggccctgcccggcgtggacgtgagccggcctcagctggtgctgccgcggctggcgctgcctgtggggcactactgctttgtgtttgtcgtgtcatttggggacacgccactggcacggagcatccaggccaatgtgacggtggcccccgagcgcctggtgcccatcactgagggtggctcctaccgcgtgtggtcagacacacaggacctggtgctggatgggagcgagtcctacgaccccaacctggaggacggcgaccagacgccgctcagtttccagtgggcctgtgtggcttcgacacaggtcagtgcgtggcagggccgtcctccctgcccctcacccgtccacacccatgagcccagagaacacccagcttgccaccagggctggcccgtcctcagtgcctggtgggccccgtcccagcatggggagggggtctcccgcgctgtctcctgggccgggctctgctttaaaactggatggggttctcgggccacgtcgccccttgttctcggcctgcagagggaggctggcgggtgtgcgctgaactttgggccccgcgggagcagcacggtcaccattccacgggaacggctggcagctggcgtggagtacaccttcagcctcaccgtgtggaaggccggccacaaggaggaggccaccaaccagacggtgggtgccgcccgcccctcggccacttgccttggacagcccagcctccctgctcatctactgttttccgtgttttagtgctggtggaggccgcgcgctctcccctctctgtttctgatgcaaattctatgtaacacgacagcctgcttcagctttgcttccttccaaacctgccacagttccacatacagtcttcaagccacatatgctctagtgacaaaagctacacagtcccccagcaataccaacagtgaggaagagccccttcccaccccagaggcagccactgtccccagcccatgtccctgttgctggatgtggtgggccggttctcaccctcatgctccccactctggaccggccaggaggcttggtgaccctgagcccgtggtggctgctcctgctgctgtcaggcggggcctgctggtgccccagagtgggtgtctgttccccagtccctgctttcctcaacgggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgccagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgccctcaccaccaaggtgcacttcaaatgcacgggtgagtgcaggcctgcgtagggggagcagcgggatcccccgactctgtgaggtcacggagccctcccgtgatgctgtggggaccatccctcaggctggcatgacgcggaggatgctggcgccccgctggtgtatgccctgctgctgcagcgctgttgccagggccactgcaaagagttctgtgtctacaagagcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcaccggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctcaccccgccccgcatgcctgccagggtactgggttcagccccccagggcagacgggcagcttggccgaggagctgagcctccagcctgggctccttcctgccgtggcgttcctcggtctctgacctgcttcagtagcctcagcctttctgctgtcctgtgtgaacgcagggtgcctctcgggggacccagggtgtaaagaggggcccagatgtggggagggactaagaagatgctgctctgtgccctccactctcccctcccctcccccttccctcccctttctccatctctctccccttttctccatttcccccccgatcctccccgtccttttgtccattcccctcatctttcttatcccccttatcctccttcccctcccttatcctccttcccctcccttatcccccttatcccccttcccctccctttccccctgctcctcctcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagcccccaccctccagctccccctttttgcctgcccccaccctccctctgcctccctgtctctgcactgacctcacgcctgtctgcaggagacctcatccacctggccagctcagacgtgcgggcaccgcagcgctcagagctgggagccgagtcaccattgcggatggtggcgtcccaggcctacaacctgacctctgccctcatgcgcatcctcacgcgctcccgcgtgctcaacgaggagcccgtgacgctggcgggcgaggagatcatggcccagggcaagcgctcggacccgcggagcctgctgtgctatggcggcgccccagggcctggctgccacctctccatcccctaggctttcagcagggccccggccaacctcagtgacgtggtgcagctcgtctttctggtggactccaatccctttctctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccactgcagctccgccaactccgttgtggtccagccccaggcctccgtcggtgctgtggtcaccctggacagcagcaaccctgtggccgtgctgcatctgcagctcaactatacgctgctggacggtgtgtgcagcgggtggggcacacgcggccccctggccttgttcttggggggaaggcgtttctcgtagggcttccatgggtgtctctggtgaaatttgctgtttcatgggctgttgggggcctggccggagaggagctgggggccacggagaagcaggtgccagctctggtgcagaggctcctatggcctttcaggcccgtggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgtgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggatgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcttcacaggagccgacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcagacggaggtgccagcaccctccccgtggctgtttcttcaatacctccattttcctttattggaattgcccttctggcattccctttttgttttcatttttctttttttggagacggagtctcactctgttgcccaggctggagtgcaatggcgtgatcttggctcacagcaacttccagctcctgggtttaagcgattccccttaagcgattctcctgagtagctgggagtacaggtgcacgccaccacacccagttaatttttcaccatgtcagccaggcgaactcctgacctcaggtgatccgcctgcctcggcctgccagagtgctgggatgacaggtgtgagccaccacacctggctgtgttcccattttttatttccgtgttgctttcatcttcatttcccagttcttttgattacctacttttaaaaactgtcggccgggcgcggtggctcacacctgtaatccgagcactttgggaggccgaggcaggcaaatcacggggtcaggagaccgagaccatcctggctaacggtgaaaccctgtctctactaaaaaatacaaaaaaattagcccggcgtggtggcaggcacctgtagtcccagctcctcgggagactgaggcaggagaatggcgtgagcccgggaggcggagcttgcagtgagctgagattgcgccactgcactccagcctgggtgacacagcaagactccatctcaaaaaaaaaaagaaaaaaaatactgtcacctgggtctgtcactgggagaggaggtgacacagcttcacgcttcgcagtctgtgcatgaactgagggacgggtgtgtggtgcgggtcactggttgtggcgtgactgaggcgtggacaggtgtgcagcgcgggtcactggttgtggtgtggactgaggcgtgtgcagccatgtttgcatgtcacaagttacagttctttccgtgtaacttaatcatgtccttgaggtcctgctgtttattggacaaattgcagtaaccgcagctcctcgtgtatggcagagccgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagtggccaccggcacctggacggcgacagagccttccaccgcaacagtctggacatcttccggatcgccaccccgcacagcctgggtagcgtgtggaagatccgagtgtggcacgacaacaaaggtctgtgcggaccctgccaagctctgcccctctgcccccgcattggggcgccctgcgagcctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggctgcgagtaaggcctcgttccatgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacaggtgggtgccgtaggggtcgggacagcctcttcctgcccagcccttcctgcccctcagcctcacctgtgtggcctcctctcctccacacagcacggggcatgtgtccaggctgagcccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaatggagcaagactccatctccaaaaaaaagaaaaaaaaaatcccacaaagaaaagcttgggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactcaggaggctgagccaggacaatcgcctgaacgcgggaggtggaggttgcagtgagctgagattgcgccagtgcactcctgcctgggtgacagagcgagactccatcttaaaaaaaaaaaaaaaatgaaattcaaaactctgttccttagctgcaccagtctgctgtcaagtgttcagtggcacatgtcgcgaggggctgccatcacggacggtgcagatgtcccatatatccagcattctaggacattctgttagatggcaccgggctctgtcctgtctgctgaggaggtggcttctcatccctgtcctgagcaggtctgagctgccgcccgctgaccactgccgtcgtcctgcaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacgtgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacaacccccacttactgggtctctccttttacaaccaacacaaccgaaatctagggcttctttttttttttttttttttttgagacagagtctcattccattctgtcacccaggctggagtgcaatggtacgatctcggctcactgcaacctccgcctcccgggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacaggcgtgagccaccatgcccagccaaatctagggctggaacatggctgcagcatataaatagaattgaattccatagttttgttaatcctgttttttgtttgtttgtagttgttgctgtttttgagacagagtctcgctctgtcgtctaggctggagtgcagtggtgtaatctcggctcactgcagactctgcctcccgggttcaaactgttctcctgcctcagcctcccaagtaggtgggactacaggtgcccaccaccacacccggctaatttttgtattttattagagacagggtttcaccatattggccaggctggtctggaactcctgaccttgtgatctgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagagagtttgggcacactctgtgtgatcgggcagaaggcctgtgggaagtttagctgaggacagggccaggaaaggtgatggacagtgggggtctgtcctggtcaccaggcccctgggtcctgcccgcctgcttggagctccccacccatcacacatgatgcggccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgacatagataaggacatcatcactcagtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtacaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaagtcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccctcccctccccctcccctccccctccccaactcagatccggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggcgctgttgcactcttgtctccaacagacaaaacggaccaaaacaaagtgaaatgtcatttgatttgtgtcatctggtttgatgacttttttttgtttgtttgttttttagacagagtctcactctgttgcccaggctggagtgcagtggcaagatctcggctcactgcaacctccgcttccggggttcaagcaattgtcctgcctcagcctcctgagtagctcagattaccacgcctggctaatgtttgtatttttagtagaccaccacgcctggctactttttgtatttttagtagagactgggtttcaccatgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaatttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtatttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccacagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattacttccttttcaagttgtgaaacatgttaacctgtggtaaaatacttacaagatgataattaccatctaaccgtgttgaagtgtacagttcagttgtgtgaagtatattcatgtcatttttttttttttttttttttgagacagagtctcactctgtcaccaggctggagtgcagtggtgggatcttggctcactgcaccctctgcctcctgggttcaagcagttctcctgcctcagcctcccgagtagctgggactacaggcgtgggccaccatgctcagctaatttttgtatttttagtagagacggggtttcaccatgttgcccaggatgatctccatctcttgaccttgtgattcacccgcctcggcctcccaaagtgctgggattacaggcgtgagctacagcacctggcctatttttttttttttttttgagacagagtttgaattttgttgcccaggttggagtgcaatggcacaatctcagctcaccacaaccttttcctgctggattcaagtgattctcctgcctcagcctcgcgactagctgggattacaggcatgcaccaccatgcctggctaattttgaatttttagcagagacagcgtttctccatgttggtgaggctggtctcaaactcccgacctcaggtgatccgcctgcctcggcctcccaaagtactgggattacaggagtgagccaccctgccagcctcatgtcattctttgtgtgtgtgtgtgtgtgtgtgtgtgtgtgtgtgtgacagagtctcattctgtcgctcaggctggagtgcagtggtgtgatctcggctcactgcaaactccgcctcccagcttcaaacggttctctgcctcagcctcccgagtagctcggattacaggcgcccactgccatgcccggctaatttttgtatttttagtagagacggggtttcaccatcttggccaggctggtcttgaactcctgaccccgtgatccacctgcctcggcctcccaaagtactgggattatacgcatgagccaccgtgcccagccgtcattcttatattattatttcctaggtgtctttcctgaagactatcttcccatctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaagtccatttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttcgacaatatttgtggcaaattcagtgggttcaaaattgagtttgtcctttctgcttcattagtttaagctgtataattcctttcccttcctacattcttgtttgtcattttttcaggggaagaggagttgctagtactgcattggttttcctttctctctcttttttttttttttttttcctgagatggggctttgctcttgttgcccaggctgcagttcaatggcacaatctcaactcactgccttttgggttcaagcaattctcctgcctcagcctcccaagtagctgggattacaggtgcccaccaccatgcccagctaatttttgtatttttactagatatggggtttcaccatgttgtccaggctgatctcgaacttctgacctcaggtaatccacccgcctcagcctcccaaagtgctgggattagaggcgtgagccaccacacccagcacccagcctttttttttttttttttaattttgagatagagtctcgctctgtcgcccaggctggagtgctgtggtgcaatcttggctcactgcaacctctgcctcccagtttgaagcaattctgcctcagcttcccgagtagcttggattacaggtgtgtgccgccacattcggccaattttttttttttttttttttttttttgagacggagtctcactctgtcacccaggctagagtgcggtggcatgatcttggctcactgcaacttccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacacctcggcctcccagtgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatggtttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacactccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaattgaaccttgttaaagtcagtcaacaccagggtggatggtttgccgttgtcacctattttcaggacataacaccctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgattttttttatccctcaatgggaggtgtccattctcccttcagttgtgagaatcagttggttcatttgtgggaaggttgcaggggggatctttgaatcacagccttcagatgccagaagggcagagggaatcccacacgggctggtggatcatgtgtgtgcatttctctcccttctagtctgaggaaactaagcatgaaagaacgtgagcacagagaagaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttaagagacagggtctttctctgtcgcccaggctggactgcagaggcacaatcatagctcacggcagccttgaactcctgggctcaagcgatcctcccacttcagcgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagtcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgctgtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcgtggtagtgcacacctgtaattctagctacttgggaggctgaggcacgagaatcatttgcatcttggaggcagagtttgcagtgagctgacatcgcaccactgcgctccagccgggatgacagagcaagaccctgtctcaaaaaaaagaaaaaggaacaaacaacagcaacgacaacaaaaaaacctctgtgtcaatcacagcctacaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgtgtgcacgcgtgtgtgtgtgtgtgtttaatatagagacagggtttcactctgttgcctaggctcgtttcaaactcctgggctccagtgatcctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgctcctggccaattttttaaggcaacgttttcagcccatggccagggtaaggcacagctagtaccaagatctggcttcactggccatgttatccaagaggcctctgcctgcctgcaaagtagtactgcacactgggatctccctggaccaaaccccagcttcagttttgggtacttcctcataagccttgactaccccagagtgtgagggattttgcagcctggtcccaggcatgcactcaccagtcaatggcatcgcggggctggccatggcctcccaagccacaaaagcaaccatatttcacataggcgatgggagttcagggaccaacacaacccacaattcctgccagttccaggatcccacgccggtgcacacataatatcctggaggctggggggtaaacaaaggtgacaggctgcaggtcagggcttcccagacccctgggaagggcatgagcctgagaggagcctaggtgttacagcctggctgtctgggtttgaatcctacttcctggctgtgtgaccttggacaaattcctaacctctctgggccttggtttcctcatctgtgaaatgggggataagctgacttcaactcatatgaatgaaatgagataatgagtataaagcccctggtgcatgaaaaggctattataatccggctgggctcagtggcttacacctgtaatcccaagattttgggaggcccaggcgggcagatcacctgaggtcagcagttcaagatcagcctggccaacatggtgaaaccccatctgtagtaaaaatacaaaaattagccgagcatagtggtgcacgcctgtaatcccagctactagggaggctgaggaaggagagtcacttgaacctgagaggcgaagattgcagtgagccaagattttgccactgcattccaacctgggcgacagagcaagagtctcaaaaaaagaaaaaaaaaaaaaggctaactattataatcaaggtcctcaaggtagccaaggagggaaaagagtcgtgcatgaaacctttgtccagttccctgtgttgggcactcggcatcatatgagcctacaggtgtctgtcaccaaggtgggctcctctgtggcagctcccaggccctggcactgccctgtgctcatgacttttcctccagactcaggctcagggcccttggtatctcctcttattttcactgccagataggaaggccccttggactgagcccagccatttatctagatcctggcacagcttggacatgtaatggtgcccaatgcatgtgactggaacccctgcattggacatgtaggaaacgaggccagccgggaaaggtaaccccacattcccacagccagcaggaactcaagcagaggcttcaacccaggcttctgacttgcaaaccagtgctccttcctccttacacagtaacaacaggggaaggtggccttccaggttgccagagccgagtggtaccagcaatagagtggaaactcacacacaggcttgcctgcttcctggtttaggtttagggtttatacggctccgggaggttgatgcattgtgtttgatcatccccttttttttttttttgagacagagtctcattcctgttgcccaggctggagcacagtggtgtcatcttgctcacaacagctccgggaggttgacgcattgtgtttgatcatcccttttttttttttttttttttttttgtttgagacagagtctcattcctgttgcccaggctggagcacagtggtgtcatcttgctcacagcaacttctgcctcccaggttcaagcaattgtccagcctcagtctcccgagtagctgggatcacaggcgtgccccaccacacccagctgatttttttatttctagtagaaacggggtttcaccatctaggctgggccggtctcaaactcctgacctcatgtgatccacctgctttggcctcccaaagtgctgggattataggcgtgagccactgcgctcatcctgatcatcttgtctctctttttttaaatagagacagggtctcactctgtcacccacactggagtgcagtggcacaatcatagctcactgcagcctccaaatcctgggctcaagcgatcctcctgcctcagcctccagatcctgggctcaagcgatcctcctgcctcagcctccagacatacgggcatgcaccaccatgcccagctaatttttaaatttttagtagatctgcggtctcactatgttgcccaggctggtcacaaactcctggcctcaagtgattctccttccttggcctcccaaggtgctgggattccaggcatgagccaccatgcccagtctcatttctgttttatctagaacatgttttcatcacactgacttttttgagaagtccaggccaattttaaattccattttgtctttttatcagtggaaaagtagcatatttatgttgcacgacaaagatgaatcaaataggaagaaaatgtaaaacacatttggggccgggcacagtggctcatgcctgtaatcccagcactttgggaggccaaggcgggtggatcacctgaagccaggagttccagaccagcctgaccaacacggagaaaccctgtttctactaaaaatataaaattagccacgcatggtggcacatgcctgtaatcccagctacttgggagggtgaggcaggagaatcgcttgaacccgggaggcagaggttgcagtgagccgagctcgtgctatcacactccagcctgggcaataagagtgaaactccgtctcaaaaaaaaaaaaaacacacgaaaataaaacggcatttagagttgaaagcttcaccttcctctctggatggtgagtcctcactctcccagcagcccacacctctgcctcaaacctccatggctcccatgagtctggttaaagctaaggagtctcactgcacctcaagtcctgggggtagtcagcccctctcacccctccctcatcctctcacacaagagtcatttactgtccctccagttatgcccggtcacgcagacactctgctgctcaaatgccctcaccccatcctcagcctgctcccaggccacctccctccagaatccaccctgcctgccaggtggtcatagggaccctcgccatactgtctgcttgtggcagtgccctccagcctggggggtcttccagagcagatctctggccaagcgcagtggctcatgactgtaatctcagcaccttcagaggccaaggcaggtggatcacctgaggtcaggagatcgagaccagccttgctcacatggtgaaaccccgtctctactaaaaatacaaaaattagccaggtgtggtggtggtgcatgcctgtagtcccagctactcaggaggctgaggcaggagaatctcttggacccgggaggtggaggttgcagtgagccaaaatggtgccactgcactccagcctgggcaacagtgagactctgtcttaaaaaaaaaaaagaaaaagaaaaagagcggagctctgatataagctgccctggcacacagtgagcttccagaaatggtcccttgacctctaaatccaccaagacccagggaacatgccctctctgagcactctgacaatgatttgcatttctctaatgaccagtgatgatgagcttttcttcacatgtttgttggccacataaatgtcttcttttgagaagtgtctgttcatatcctccggccacttttggatggggttgtttttttcttataaatatgtttaagttccttgtggattctggatattagcccgatggatagattgcaaaacttttctcccattctgtaagttgcctgttcactctgatgatagtttgttttgctgtgcagaagctctttagtttaattagatcccatttgtcaattttggcttttgttgccattgcttttggtgtttcagtcatgaagcctttgcccatgcctatgtcctgaatggtattgcctaggttttcttcttgggtttttatggttttaggtctaacatttaagactttaatcaatcttgagttaatttttgtatcaggtgtaaggaaggggcccagtttcagttttctgcatatggctagccagttttcccaacaccattttaaatagggaatcctttcccattcttgttttttattacaactttttacctaaacattcaataattttcactaactttttggcaatgaggcagctgagtctaagtaggttaaatcacttatctgaggtcacacggcaggacagtgcttgttctgcaaagttaagtgtgtttctttttgtggaccatgagaacatctccaactgccctttttgacttggccaccagggaactcagcgccatgttctcaaatccagtttagtaactggccttctggcctgtatatctttattctaccttccatcctgctctgttctgcttttacctcttattctagattatctttctttagtcctaattttaaatttatatctataatcttgttatatatatttcttggcatctactgtaagtgggtagtgaacgaataaacaaaatgtgatgaattttagaggactaagaggggcctaagtcacaccaagattcatgctggataatttgtcatcgacccagactgtggttctgcactcgccagtaaccagtttttttttttttttttttttgctttttgccaaccatacattttgctttcatggtatcgaagtggtttaagcttatggcttccagcctgcagtggctatgaggggtcagtctctcatcaggaggggttggcagactctgttctcagataggcagcaaggatggaggtggggcaggagcaatttcactacctgcctggcgtctgggtcttgcttagagaaataattccaggctctgctgctttcgactctgtctctcatggttccactgattcctgcagagatctagagagaaaatttccagcgaggagtttctggctcgtttgattttgaacacgttttgagtattccaccccttacccccccgcccccactcactactctgtagtttttttttttttaagaaaacagtttgaaagcacaaataaataaataattcaaaacagaggggccatttttatttactttggttgtttcaggagagggaagggagcttacactttttttgaactcttattctatgccagccgatgtgctgcattcttagcttaaaagcctgcttctctttgatttcagaataacttggaaataaatgatcagaccctgcatgctctgatcctggctgtctgctctaactaaatctcctcttccttgcttcctccagcgagttgttctcccttcacctcccagcacaagctttgcacgtgttgccgtctgtcctacaaaggtctgtcccttcccagtctccgtgtgactccctccttcacacccatggttctccactgaaatgtcctttgagcacgtctcagatgcctcagtctaaagtagatgattctgggctgggtgcagtggctcacgcctgtaatcccagcactttgggaggctgaggcaggcagatcacctgacatcaggagttcaagaccagcctggccaacatagtaaaaccccgtgtctactaaaaatacaaaaataagccaggcatggtggcgggtgcctgtaatcccagctacttgggaggctgaggcaggagaatcgcttgaacctgggaggtggaggttgcagtgagctgagatcacgccactgcactccagcctgggtgacagagcaaaactctgtctcaaaataaataaataaataaataaataaagtagatgattcacagaaacctctgttcttttagagcactcttcaacactttttatgctttttatgtttgatttctaataaatatgtttctttcactataccataagtatattccttcttctaagtttcattaaggtagaatcacgtatgtcttatttcctgttatatccctaagtacctagcatgtagtaggcattcaataaaaattgattgaatgattgaacactcaatcccatgatttgagtgttttttttgtttttgtttgtttgtttgttttgagacaaagtcttgctctatcacccaggctggagtgcagtggtactatcttggctcactgcaatctctgcatcctgggttcaagtgattttcttgcctcagcctctcaagaagctgagactaactacaggcatgtgccaccatgcccagtgatttgttttgcatgtgtgtgtatttttagcagagatggggtttcactgtgttggccatgctggtcttaaactcctgacctcaggccatccaccctccttggcctctgaaagtgttgggattacaggtgtgagccaccacgcctggccttttgtaattattctaacagctactacttattaggtgctgactatatgccaggcactgtgccaattgatttatttattttcagggattgggtcttgttctgtcaccatggctggagttcagtggcacaatcatagctcgctgaagcttcaaactcctggggtcaagcagtccccctgcttcagcttcccaagtagctgggattacagagatataccattacactcagctaattttaaaaaatggctaattttttttttcagagatggaaaaaaaacaaaaaacaaaaaacagctactacttattaggtgctgactgtatgccaggcactgtgctgatttttttttaatgttttttatttttttagagttggggtctagttctgtcaccatggctggagttcagtggcatgatcatagctcactacagctttgaactcctgggcttaagcaatcttcctgtctcagcttcccaagtagctgggattacaggcatgggctatcacacccagctaattaaaaagacattttattgtatagataggggtctggctgtgttgcccaggttagtctcaaactcctggcttcaagcgattctcctgcctccacctcccaatgtgctggtgttacaggtgtgagccatggcacctggccctgtgttgatgttttacatacagcatctcatttaatccccaccaggatcctgtggggatggattggattatcccccactccttggaagagcttaaggatacccaaccagttggtgattgagctgggatttgaactcaggcattctaatggcaaagctgtgccccttccactctaccatcgtgttcctctccaggggaggtgtccctgcagtgctgtgactttgtcgtcgaacatgtgctgaggtacgtgaatcctctggagaagaagggcaaaggaacaggctttccaggcaggaagcccctgcaggcgagggaggaaggctgcaagggacatggtaggaggtatcttgctccccatagctgggctgggaggatgagatggctgagagccaggagccgggctggggttaggctcatatcagcctgcagagggctttggggaacccaggctttggggccagacaaacatagcttctcacccacctgatcatttcctctctgttgtatcctatgtttctgggtctcagtttccttatctatgaaatggggataccatgacctgttctgcctgcttcatagagtgctaaggagcagatgacataacgtgtgcaaaagcagctgttcttatttctatcacttattttcattatcgctattctcaagcaggcagacggtaattttttacctctttcttttttttcacccttgagttgtttggaagttatttttaaaagtctttgaagtgtccttttccatatttggcaaaagcaaaatggaaattgatagcattgtcaccgtcggcatcccctcactccggccgcctggctgggggacagctctgggaaaatgtggagatgtctgttgtgggcgactggtttgttattgcgtgaacttttctggcgagacctgaccagctcccttttaaggcaattcctcgtgttcttgttcctcctcttttcttttcctgccaatgtcaggtcctttgtgccatctccaggctcagaaatccgtacagccagagtcggtccccagtttggccacttccagctgaaaagctttcccatgccttccctttaacttagaatagcatccaaatccttcattgtgaccaaggccctgtgcagtctgctcctgtcactttcctctccattactcagctccaaaagtgtcacctcccttgactcctccaatgccccacatggtttccagccccagggtctttgtggggtctttgccaggaatcctgttccccgtttttttgttatgggtagctctttctcatctttgacatctctgctccagagtcaacttcacacatggctcttccctaacccacactaaaaaataagcctccttaaagaaaaaaaagaggctggacgtggtggctcatgcctgtaattccagtgctttgggagactgaggtaggaggatcacttgagaccgggagtttgagatcagcctgggcaacacattgagaccccatctctacaaaaaaaaaaaaaaaaaaaaaaaaaatagcgaggcgtggtgctgtatacccatagttctagctactctggtggctgaggcaagaggattgcttgagcccaggagttcaaggctgcagtgagccgtgattgcaccactgaacaccagacgcagtgtcatgtacttgtagtcccggctgcttgggaggctgaggtgggaccatctcttaagcctgggagtttgaggctacagtgagccctgatcatccctgtgaatagccattgcactgcagcctgagttacacagatacgtctcttaaaaaataaatgaaaagaaaagccttttaaattcagtgtcttcgcatagttagtccaaccttaaggagtgttaccagatacaaacaggatgcccagttacatttttttttttttttttttttttgagacagagtctcactctatcccccaggctggagtgcagtggcatgatcttggctcactgcaacctctgcctcccaggttcaagtgatgctgatgcctcagcctcccgagtagctggaattacagacgtgcaccaccaggcctggctaatgtttgtatttttagtagagatgggtttttgccctgttggccaggttggtctcgaactcctgatctcaggtgatctgcccaccttggcctcccaaagtgctggggtgacaggcgtgagccaccatgcctggcaaaactttgtagcccagtttgttctatttttttttttttttttttgagacagagtctcgctctgtcgcccaggctgtagtgcagtggcatgatcttggctcactgcaatttctgcctcccgggttcaagtgatttccctgcctcagccttccaagtagctgggaatataagggcgtgccattgcacccaaatttgaaccttagataaacattgaataattttccagtattacatcagatacataacttgtatttaaaaaatcattccttatttcactggatttaaaattgaattgggtgtcgtatatttttacttgttaagtctggcaaccctaccctctagagagaggtgttgaatgaatgagtgtgaagtccttagcttagggcctggcactcagtaggtgctaagtaaatgtcacctgtcagcatcttcctcctcctcttcttcctcctctagttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagtgagttatcacagagcgttccctccagcactgggtcatgcaaatatttattgcgagcgttaaataataaatggagcagcctgcccaatggtaaatctgtcatgtttggtttcagccaggagttgtgatggctctggaatcgctgcccgtttcaccgcatccacctgccctctagaggagcaaggcaaacagccgagttctctggggtggcatcagtgggctggtgtggaagccagaggggcggtggggggagtcagccaggcatggaaactggcaggtaaggcagccctgtggcccaggaacctgagccgcagccacaccgagcaggcctggacctttgagtcccgctgccaccacagttctcaggggacacggtctcattgtccacatctggatttatctttccgtatttccctcattgctcttgtcagcttcactctggctgactggctggagctggcaagcttctgaaagtggagtcaaccttccgaccctttttctaggctgagtggtgggtggaggaatgagaccgtgtgttggactcaaactcgatgcaataacgtttcccagcccctgtggtgtgctggggctcctagcacacatcctcttgtttaacctcagcattgcaacctgaaacacagacacatgggttcttgagccagatgcctctgagttggaatcctatctctgcacttaacaagcggtatgaccttgagtgagccacagtttttcagagcccctgtttcctgatctgtaaggtgggggagatggtggcactcaccttatggggctgttatgtattagtccattgaggtgtcttagcctgttttgcgttgccataaaggaatacttgagggtgagtaatttataagaaaagaggtttgtttagctcacgttctgcagactgtacaagaagcatgatgccagcatctgcttctggtgagacctcaggaagcttttcttcactgtggaggatgaaaggggagcaggtgtgtcacatggtgagaagaggggtgagagagagacaggaagggtgccaaacacttttttaacaatcagacctcgccgtgaactaaaagagtgagaactcactcattactcagggagggcaccaagctattcatgagggatctgctcccaccacccaaatacctctcgccaagccccgcctccaacattggggatcacatttcaacatgaggtttggaggggacacacatccaaactatcttatgaggtagtaggataatgtaggtgaagacttgcacagtgcccgggacctggggacaaatgctagctctaatggttaataatggtccagagaagaaaataactgctcagatgcacagacatgactgcactagtcaaccatgcaggtatgagtccccatcctagagtatggggtgcatagagctctagcccaccattattgagttgtagaactaaggctccaatctggggctttatggatccctaaatcatgccctttcaccttccccatatctgctttattcctcatagggtggcagggagggtggagctcatgcctggccttaatcatcatggcctaagtttggtagtgtccaaacagtggtgaggggtgaagttgtagggttgccaggtaggttgtgtttggcttcaaatcactgagaacccaactggaagtggtgtagatgctaatggaagttattgtttctctgcagggggccatgtggttaattgattcagtggctccattgtggaatggtgggccttgtttccttccacttttccactattccattcttagcagctggctcttgccctcagccacaccccatcatggtctcaagataatatggacaagagagaagagagccttcttccacttgttccccgcttgtttttgagacagggtctcgctctgtcacccagactggagtgtagtggtgcaatcatagctcgctgcagccttgaacttctaggctcaagtgatcctccttcagtttcctgagtagctgggactataggtgcatgctaccatacccagctaacttcagagttttttctagagatgaggtctccctctgttgcccaggctggtctcgaactctgggcctcaagtgatcctcttgcctcaacctcccaaagcactagggttacagatgtgagccaccacgcccagcccatctgtccctttttatgatcattttctcattttctcagaagctgccagctgacttctccttcatcgcattggtcagaaatgtatcacgtgcccttttctaagccagttgctggcaagggaatggaattcccaaggttgccttagaccagtgcttcttaaagtgagatccccaggccagcagcatctgccatgtctaggcaattttaagaactgcaaattctcagaccccagttcagacctactaaatcagaaactctgggggtgggatctatgtttttatttatttatttactagaatcggggtctctgttgcccaggcaggagtacagtgacactatcatagcgcattgcagcctccaactcctgggctcgagcgatcctcctgcctcagcctcccatgtagccaggactagaggtgtgcacccccacacccagctaatttttttattttttgtagagacagggtcttgctatgttgtccagtctggtctcaaactcttggcttaaacaatgctctggtctcaaactctcagcctcccaaagtgttagaattacaggcgtgagccactgcgcccggcccatagtctatgtttaaacgtgccctccgggggtttctgatggacactgagtttgagaacctctggtttcctaagatcttttcctctgaagagccagagaataaatatttcaggcttgtggccacacagtttctgtagcaaccactctgttctgctgttgcagtgtgaaagcagctatagatgataataaataagtgaatgggtttatttatggagactgagatttgaatttcacctaatttttatgtgttaggagatattattacacttttgatcttttctaactacttaaaaatgtaaaagccatttccagctcctgagccgtacaaaagcaggtggtgggccgggtttaggcaatggtttgccagccctccatcagactgctcaagattcatcccctgaaactggggagagtctaatagtcttaaaacacagagagccccagattctttagaaaattggaatttgggctgggtgtggtggctcacatctgtaatcccagcactttgggaggctgaggtgggaggatggcttgagcccaggaatttgaggccagcctgggcaacataatgagaccccatctttacaaaaaataaaaataatagtcggacgtggtggcatgtacctgtagtcccagctactcaggaggctgaggcaggaggatctcttgagcccaggagtttgaggctgcagtgagctatgatcacgccactgattgcagcctgggtgacagagcaagacactgtctctgtctaaaaaaaaaaaatgaaatttgggccaggcgcggtggctcatgtctctaatcccagcactttgggaggccaaagtgggtggatcacctgaagtcaggagttcaagaccagcctggccaacatggtgaaaccccatctctactaaaaatgcaaaaattagctgggcgtggtgacacgtgcctgtactcccagctactcgagaggctgaggcaggagaattgcttgaacctgggaggtggaggttgcagtgagccaagattgcaccattgcactccagcctgggtgacagagcgagaccctgtttcaaaaaaaaaaaaaaaacaaaaagggctgggcgtggtggctcacgcctgtaatcccagcgctttgggaggccgaggcgggcggatcacaaggtcaggagtttgagaccagcctggccaatatggtgaaaccctgtctctactaaaaatacaaaaattagccgggcgtggtggcaggcgcctgtactcccagctacttgggatgctgaggcaggagaattgcttgaacctgggaggcggaggttgcagtgagccgagagtgcaccactgtactccagcctgagtgacagagcgagactccgtcaaaaaaaaaaaaatactgataatgacagtgctaacagcaataatagatagctaacaagtgtggagtgcttatccatcttctagtccccaccttcctttagcccaggagttcgaggctgcagtgagctatgattgtggcactgtactctagcctgggcaacagagcaaggtcctgtctctaaaaaaataaaagcataaaaataaaataaccaaactttttattaaccttctacccccagagggccccctccctcaaatagctcattaactagacctggtttgcatgcccaccccctctagggactgagcccaacttctgagatagggacccttgaaagaactggggttctgttagcaagaagaattaagacaagaggatgacttttggtgttgacagtgtctgcccctgttttttgtttgtttttttgagatggtgtctcgctctgtcacccaggctggagtgcagtggcgtgatctcagctcactgcaacctctgcctcctgagttcaagcgattctcctgcctcagcctcccgggtagctgggattacaggcgtgtggcaccacacctggctgatttttgtatttttagtagagacaggatttcaccatgttggccaggctggtctcgaactcctgacctcaggtgatccacccgccttggcctcctaaagtgctgggattacacgtgtgagccaccgtgcccagcctgccacagttctttacacatttgatctttagctcacccaacaaccttgtaaaaatatgattgctacccataattttcaaataatctacgtatgcgtaagagagagaagtgattccccaaagatcacgcagctaataaagtggaagggagaacccaggcccacctggctccgaagctcacactctttccactaagctgcctgcttctttcattggaatagaggttctcaatcgtgaatggtaggagtggggtgcggtgaattttgaccctcgggtgaaatttgaaaatgcttggagacatttttggttgtcataattgggagaaagggtgtgatattggaatctagtggatagaggccatggatgctgctaaagtttttatagtgggccgggcgtggtggctcatgcccataatcccaatattttgggaggccgaggtgggtggatcacctgaggtcaggagttcgagacgaccctggccaacacggtgaaaccgcgtttctactaaaaatacaaaaattagccaggcgtggtggttggtgcctgtaatctcagctacccgggaggctgaggcaggagaatcacttgaacccaggagacagaggttgcagtgagctgagatagcgccactgcactccagcctgggcgacagagcgagactctgtctcaaaaaaaaaaaaaattatagtacataggacagccccacaacaaagaattattcagcccacaatggtgccaaagttgagaaaccctatatactaaaacaagctctttgagggcagggatcatactaccttgactaccttgttcaattctcaatcctttataccctgcctgtcctggcacattgtaagtgctcagtaagtaatgactgagcaactgagcagatgtgctacaccagattccagagtcaaataatcatagacttggagaagtgcagggttatgggggctgcagtataacactctacctcacagtgggtgcatccaagccaccagcttcccctggttccagaaggcctgttagagacatgtcttgcatttgcacttggtccagcacagcccatgcctcccacttgtgaaaagaggctgactgatgggtggtgatcagggttggctgccttttcatttttgagatcatgggaacagagggaccggatgaagaaacacttctctgaatctacccatttctaaatggatgaatcaccaaggaggaaactcaaagattaatttctcactgcccttcttcccttgctctgctctttgtagacagttactggtgctccagggcaaaagataatgaaagttcttccttgcatcaaactattttcttcaggagatagagccagcattagccaaagagatggtctgggctctgggagcttggcttggaggcccaggacattcaaacagtccttcccggagaacaggctggacctgcagtgatgaataattattttgcaattgacagttcaatacccaccagattcttcattgtatgtttctgtatcgtgtcaagttatgagaaaacgcaatattctttaacagctaggcaagaacaatggtttttgctcatttgtttgtttgtttccaccccgcagaggtcagtttttgcagtaagaagagtctcattctttttttattttattttatttgtattttgagacagtctctctctgtcatccaggctggctggactgcagcggctgcaacctccatctctcaggttcaagggattgtcctgcctcaaacttctgagtagctgggactacaggcatgcctacgccctgctaatttattgtatttttagtagagacaaggtttcaacatgttgtccaggctggtcttgagctcctgacctcaagtgatccacccgcctcaccctcccaaagtgctgggattactgccatgggccactgtgctcgtgactcttcaagaagagtcttgaatttactctgaatgtgtccttggttggcacaaccacgagcagaatatgcatcctatctatcctcacaaacactgcgtttattatccccaatttgcctttgaggaaatggaggctcagagaggttaaataacttgctcaaggtcacgtgggcaatgagtggtggagtggagatttgaactcaggactgtctgtgaccctcccagccctgcagtctccaagtctccagtactatctggctctaaaatccgtactattccctctgctatgtttttgtggcgacttgaactcttccttcaaagtcttggctgctgctatgaactgaacgtgtaccttgtgaagttgtattttttccatattgtaattccatccttcaaaagtaagtcttgttactgaaagactgtttcaaccgtcctggggtaggagtggctaacaggttggcttgggtcccacagtgaaatctgttctgagccagaccctcccgaggggacaggggacgagcaggagagattgtagctgaagtagacatctcctgggttcccagaaatgtggaagaaccttgtgcaaaaacagcttcctgcagagctgcaagatgggatccaggttattggtatttgagcactgtgtttaggggctatgagagaaacctaacatgaaccggctgaaggaaaaaagtggaggattacatgaaaatgaattcagggagcttgcaggtgtactgaagggaagtgtgagctctaaaagctggaaaaggtctaaacgtgtagattacaaaaatatctgcagcttagcatggcaatgacggataaagcgtcagatatgtgtttgtcatccagttgtctatggctgtgcaacaaaccacccaacatgtagtagcttaaaacatgacagtcatttattttgctcacacatccacaatttgggcaggatgttgaggggacagttcgttcctgctccacgtggcatcagctggagctcaccagggggctgcagaattcatttctgagatggctcctctagcggttgctaagttggcgctttctggttggctgggagctcagctaggctgtggtccaggggacttggttcctttgtttgggcctctcctctcttcagctacttgggcttcctcatcgtatggtggctgggctctaagacaaggagaacccagtggaagctctgtcacattttatgatgtagccttggatgtcgcataacgtttcttctatattctattggtcaagcaatcgcacagtctggattcaacggtagatgacataggttctaccttttgatgaatcaaaaaattctgggatcatggtttgaaactaccaaaaagtagcggctgtattgtttgttattattacaaagtaggccgtgtgcagtggctcacacctgtaatcctagcactttgggaggccagcctgggcaacataatgagacccggtctctaaaaaaaaaaaaaaaaaaaaaaaggagagagattagccaagtgtggtggtgtgtgcctgtagtcccagctacttgggaggctgaggtgggaggatcacttaagcccaggagatcgaggtggcagtgaactatgatcacactaggctgggagacagagtgagaccttatctcaaaaaaaagttaatgataattactacaaagcaaggccaatagtacaaaaacagtgatctttcacagtctatgatatagcaggacagtgctagatgttccccatctgctatgccatttattcctccccaaaatttgggaagctcagggaggcatataaactgcctaaacagggccgtgaagctaggaagtgctaaagccaggatttaaacccagaagtcaaatgctaaagactctgctagactgactacctgattctagaggctggggtgtgtgctaggtatctgaaagattggagagatgcagacagaaatgtgtgaatgtgagtgtgcaaatttgcacaaggccagtagcacctaagggggcccatgtgggagatgggagggtccctgccatctgcttccttctcctcatccatttcaccctggtcttctcagccctcccctctcctccatgcccctccttggtctcttcccatggaccctgtgagagcccctctccagctgtttatgggagatgttgaaggagaagcaagggctcctcacgaccctgtctctgcctctttcctgtgctctgggacatctgaactgtcacatagtcagctggcagggaagcccaattttcctttggctctccaaagggcctgattcatgggttaggctgagatcagatagagcccttgggtcaggtgggtgggattctggctcccagggctgctggcaggtgccatctggttgttctggagggagttgaggggaatggttcccacctggacagtgtctgaggggtgagctggtgaagcactgggcgggtggggagctggcagggacgggacagatacagagagtgccaggaggtgtggacagctgctcgcagggctcttggtgactttgccaggaaactgtgtctagacagcctctgtctgatctctcttctcatcccacatcatctccccggttcctccctggcctgaggccgtcctgccaggttggtgcagggatatgttgaacaaagttcagatgtgctgtgtgcacagtaccaggctcagcatagtctgagaatgaaaagcagcttctgaaactcagccctgcctcaggtgcagggagctgctggtcttgccaggaggcttaatgcctggatcaaatatgagggggctggctgggcatgatggctcacactcgtgatcccagcactttgggaggctgaggtggtgggaggattgcttggggtcaggagttcgagatcagcctgggcaacatggtgagactctgtctctacaaaaaaactaaaataaaaaaatagtcggatgtggtagtgcacatctgtggtcctagctactggggaggctgagataggaggatcacttgagcccaggagttcaaagctgcagtgagctgtgattgtgccattgcactccagcctgaatgacagaggcagaacttgcctccaaaaaaaaaaaaaaaaaaaaaaagacaaatatttgggggcttccccagatagacgtctggtgctatggtctgaatgtcattgttccccttgaattcatatgttggaacttaatacccaatgtgatagtagtaagaggggccccttaggaagtgactaattcatgaggaatccaccttcatgaatgggattagtgcccccttttataaaaggggcttgagcaagcgcctttgcctcttttgccatataaggacacggcaacaaggtaccacctatgatgcagagtgagccctcctcaccaggcactgaatctgcaggtgccttgatctgggacatcccagcctccagaactgtgagcaacacacttctgtcatttataaattacccagtctaaggtattttgtgataatagccccaaaatatgacacccagagagtgtgggccctctagaggtcatttcttccaggcccctgccagatgctgagctcagcctgcaaccccaggctgttgaaaatccgaggaggctgaggtcagggagggaggcaggaggccagcaggccatcagggaagggaccccagtgggctcttgaggaatggggaaggggcattaaagggcccaggtagaggcctggagtggtggtggtggccgtgggggtgtgagaagctggtttgggtgaagatgcagggagacaaacagagacccattgggcacggacaggtgctcacatgtttccttgcacctggcatgcttcccctggtgaacactgccaatgtccacccacctgttcttcacccaggtgggcctcgggtctgcagggacacagcaaaggaatgaaagccaggggcaggggtttaaatcctggctctgtctcttttcctccgtgtgacctggggcaaggaaatggtctttatagctcatgcggtctttatgcagttgtcttaggtgatgggggatgagaaagtgccttgtaatcaataaagacagatttattacgataatacaaatttattgatttgtaatcagtaaaggcagattaaccataccatttttttttttttaaatagggtcttgctgcgtctcccaggctggagtgtagtgtcatgatcgtagctcactgcagcctcgaactcctggctcagactatccttccacctcagtctcccgagtagctggagctacaggcgcacaccatcatgctcagctaatttttatttttatagagatggggatctcactatgttgcccaggctggtcttgaactcctggcctccagcaatcctcccatcccagcctcgcaaagtgctgggtttacaggcgtgagccactgcacccagacaggatcaaccgtatcttttgagcatccgttctgtgcctggcaccaggaccagttgctgtgggtcaacagaacagtttcaggtgggtggtggatggaatggctggtgggctcagagctagagcttaggcccctcagctactcctctgggcaggagtgagcagtgctcaccctaccccaggcttaggccacttgcgatgtggggttcctcttcgcgcacatctactgaccctggaactattgaagctattttgtgagtgctgtgccctctctgctgagacacaatccctgtctggcacacccccaacacatcatttgcccctggagtttaactgtactttggtgaagagtggcagaggccagagggaccccaggggtggacatgtgattagcttgatgggcaaccccaggacagagaacagggatggggaaggagatgcttcccactgaagaccccatgcactctgcagcttacaatgctcctaaaaccccgatgctggtttataaactctcttgtccaattgctggggttcaactgggagccttggtgtgtcccgcccctcccccaggctgtcccgttgtcaggcgagaatgaggcttatttctgctcatccaccaagcttgtctgtttccaactgtccattttttttccatccatctatctgcccgtccatccatctttccatcacctcctgtccttaggcttaggggatttcctcttgggaggggaactctttttgcagaaaaggacgctgagccccaaaagctgagtatttcccagcataaatgtctgagccctgttccctgggcaggtcctgtattggggattcagagttgaattggagttgtctcagcctgtgaaggaaagagacctgtcaacagggggtgacaaggagagtttgtagccaggtgtggtggtgcacacctgtagttctagctaattgggaagctgagcagggaggaatgcttgagcccaggagtttgagaccagcctgggcaacatagtgagatggccccatttctacaaacattgtgaaaactagccacgcatggtgacagatgcctgtagtttgagctaatcggtagtctgaggcaggaggatctttggagcctaggggttcgaggctgcagtgagctaggattgtgccactgccttacagcctgggagacagagttgcaagactcccagttgcgatcatttaaaaactgggagactgacatagcatctggcttttagcttctcttaatttattagaagctctgacagcattgggcccatgttcccacgtggagacagttggtggatacaagataggcagctacctccgtctttcaatggggcatgcactccaattcaccacagaccccaccattccctactgcttctcattcctccctttcttcacttatgttatctgcctggactctctacaaggattttcatttgtggttcctgtttcaggaacaggccatggtgtggcctttcctgaccttgtcaagcctcaggttcccagaggggaccaaaatagatactgcacattgtagagggatcagctgaggtaatataggtgaaagctctcaggaagcctaaagctctctgcaatcacaaagctacacaaatagaaattattatcatcattatttataaccattgaaaggacaggagacaaagaagtcagtccccaccatacccctcccaaccccaagcccacaagggtatttgtgccattatgatggcattgatcattgacattgacagttattattaaacgatgtcaacttccaaatgcaaaatgtttaccagatgaactcaaatgggctggcagaaataatgtccaggtgccatctaccttcaactcctcttctcatgaatttctgtggcatttctccagggcccagagtcaataagggagagagaaatgactcctctggtttactgaaggtgtgacttgtgattccagccaatgtcctgttggtcccattgtctcccctgccactacccatgtggagtcttagatcttggagactgtactatgtgggccaactctctcctcaagacacatttattaaaaggtgggtgaagtatcttctcctttgcctgtgtcttttgcccaaagggaagttgattgatgacaatgctcctttttcaagctctgattgccggtggaggttggataaagcatcttgctgtgatctctaagtgggctgtgccttgaaaacatgattgttgtgtctaatcatgtgtgtctgtggctcccttgccactcctggttgccgtgtcactgtgactctatttaacatactttcaggacccactgtatctgtcccgcctctctctggatcttcccaactctgtggttgcctccctgctatattcatggcccctaggggatgccacgtgtgttcggttcttcatgctgttcctctgtctaaaatgttctcttctgtggcagcttcctgcaaacatcttcttctctttccagactttctttgatgattaagaagcttgcacgacctaagtcttataattctgaaaatcatctcctagtttccaggaccccagatgcaccagcatggcttagggaaaggaaaatgacctttggagagagaatctttggagggatttgagcctcggcattgccacttactagctacaccatttgggacatgttacaagcccccctgaacctcagtttcctcatctgtgaaatgggcataatgataggccctaaatcttgtggtgaggcttacatgtgccaatggatataaagtatacatcatcacaatgcctggcacatgatgaaagattaataggggcaattaatatagtgtttgtgatagacccaaagatagactgacccgaggccgaccctgggcaccttttcaactgaaatcccaccaccttatattttgacttctaggtttcctttccctaaaagagaagtttggagaaggatctagaattgttggttaatcaagggcttgctaccttctaatcacttcatgttgatactaggataaagagcaaacatccttcatggggtttacaaggccctccatggccaggaccgtgtttatgtccccagcctcatagtccacttctcctctctccctgggtggtgacacattacacagtaccctcgcacatgctcttttgcccacttaatgcctgctcattcttcaaagcccaggcacttcctctggaagccttccgcagctccctgtgttccttctcgacagagtgtaaccgcccattgggtccaccttgcccgctgcctagacagagctgatttatcaagacagggggattggaatacagagagagtaattcatgcagaggggcattgtgggagactggagtttgattatcactcaaatcagtctccacaagcatttggggagcagagtttttaagaacagcctggtaggggtggttagttgaagccagtgagccaggagtgcagattggtcagggaagaaatcatagggagtcgaagctgtcctcttgcgctgagtcagttcctgggttggggccacaagatcagatgagccagttgatcgatctgggtggtgccacctgacccgtcacgtgcagggtctgcaaattatctcaagcactgatcttaggaacagtttagggagggtcagaatcttgtaacctccagccgcctgactcctaaaccatagtttctaatcttgtggctgattttagtcctaacaaaggcaatctagtccccaggcaagaaggaggtctgctttgggaaagggctgttatcatctttgctttaaactacaaactatgaaccatgaactcagtttctcccaaagttaggtcagcctacacccaagaatgaataaggacagcttggaggttagaagcaagatggaattgatcaagttaaatctctttcactgtctcagtcataattttgctaaggcagtttcaagagcacttactctagtttctggttttacattcatgactgtgttttatttggttcatgtctaattcctccactggaccgagagctccatgatggcaggaaccaagtccgtgggtggccccctgtggtgtccccagcattgaacacagcagcacgtccctcatgggtgttcactacataataatttgttggatgcacaggtggatacatgacttactactttaagaatgtgtgcatttgagatgtttacttggaacaacgaaggcttattcttgaagaaacaacaagtgataagtcaccagaagacagaaaacagcatgttggagctgggtggctcctggtgcctgggaaatgaacccttggggtggttcttggaaggaagtgagcaggtttagtcccatctgatgaactctttcctctccatggttaagttggcttctaactcagggactaagttttatttgagactgaggccactgctggtgggttggttggtctcctccacctttcccttcacccgtaaatgggatattagtgaacgggtggcataacccacctgagggttcttatagggtttcaggagaacagccctcatctcccaatttcctgaactgccatcaagataactgtgtgtgtgtgtgtgtgtttgtgtgtttaatcgagacagagtctcgctctgttgctcaggctggagtgcagtggcatgatcttggctcactgcaacctccgccactcaggttcaaacaattctcatgtctcagcctcctgagtagctgggattacaggcacgtgccaccacacctagctaatttttttttttaagatagactgatttttgtatttttaatagagatggggtttcaccatgttggccaggctggtctggaactcctgacctcaggtgatctgctcaccttggcatcccaaagttctgggattacaagtgtgagccaccacacctggctatcatcaagataactctttaaataagccaaacatttattggccaaaagcaatgcacatgtgctgtcaacaagcaaatttggggaaacacaaagagaatagaaacagaaaataaatattaaccacccagatgtaatcatattagcattttggggcatatgtttctgattctttttaaaaaatatttatgtctctctgtgttttctatttatatatgtattgcaacctgatttttttcattgagcaaatgtaaaatgaacagaaaatgtccaggaaagcaaatgtctcccttctgctggcctggtgtattacacagggttctgtggagggacagaactaataggatagatgtatatacaaaggggagtttattaaggggtactgactcacacggtcacaaggtgaagtcccacaataggccatctgcaagctgaggagcaaggaaaccagtctgagtcccaaaacctcaaaagtagggaagccagcagtgcagccttcattctgtggccaaaggcttgagagcccctggcaaaccactggtgtaagtccaagagtccaaaagctgaagaacttggagtccaatgttccagggcaggaagcatccagcacaggagaaagatgaaggccggaagactcagtaagtctgttctttccaacttctgcctgctttattctagccacgctggcagctgattagatggtacccacccagattgagggtgggtctgcctctcccagtccactgactcaagtgtaaatctcctttagcaacatcctcacagacgcacccaggatcaatactttgcctccttcgatccaatcaagttgacactcaatattaaccatcacacctggtatgacagtactagccttgtcccaagaggcaggagccccagaactgcagagcatctgatagagatgtgaatagtggctttggaaggaatgactgtggccaggtaaggtgacaggtaatggcgaaaacaggcatgaaatcgtggggcagttcaggtgagccattccccaatattcaccaagagataatagggaagggagagagagtaggggtctcaaaagcagggtcacggtgctgataatctgaaaggtagggtctcagagccattgaatgtttcatttattcactcaacgagaatttcttgagtggctaatatgtgccaggtgctgcagcagccagtggggattgtaggtcacaaaaacatgacttcattcaaagcatgcaccattatttacatatgtaaagtgccttggcatgaaatagaagcccaataatctcttgcaaccatagagatgagcattaatgacttttccagaattgcatctatggttggtgattattcctatgtggccaaatgaccagaaggagcagaaagctacatttttgtggcatcttgtatacatagaaatgattgctgtaaatatatgttgactccctttaatacatatgcaactaattgaaagcgggcagtttatggtgtagtatcagtgaaacgtgctctgttgccattaagtatagctttgttacattattgagacaacttgccttgggggcactggggtaagttattgcttcttcaaccatattttggtccttagaggaccaaccgctagtccagcttttattacctgctgtttctttaatcacaacagggaaatgttggctaggcatcggacgggagacttttcttataagatgaaatgagccaagattggaagacgacatttttatttgccttacaaatggactggatacagtgtgaatggcttcgtgaatgagatgaagggctctgctgcgcagcaatcccaaaccattcacccttatgcagaggcagagagcctcctaaatgaattgggttctgttggagttagctgctcttattttcctgtgctgaggagtctggagtgggagggtatccatttcccaaccaataataattagctttgattccaggcaacatgtgcatttttaatccgttaggcatagggtcttcccgggacctatacgtttttcaagatctacagaaatgtttgagaccaaaaacaaacaaacaaacaaacaaacaaaaaacaccacacaaacacacatacacacacacacattggcttaaaaatgcaaaagagaaaatgacaaaattgaaattaatgaatatcttaaaaattacctacgctgggcatggtggctcacgactgtaatcccagcactttgggaggctgaggcaggcagatcacctgaggtcaggagttcgagaccaggctgaccaacatggtgaaaccctgtctctactaaaaatatgaaaatgagcttggtatggtggtgcatgcctgtaaacctgtaatcccagctactcaggaggctgagacaggagaattgcttgaacctgggaggtggaggtggcagtgagccgagatcatgccattgcactccagcctgggcaacaagagtgaaactccttctaaaaaaaaaaaaaaaattacctacaaattgtgctgctttgtcaatatcactaattgttaaatttaacattcctagggatttcattacatctgaaaaatgtggatagttagaatttcccactttctagacctcctgaatatgcacaattaccaagaaatcacatccaatctaaatttaaataaatcacctattgccagataatttcaggagcagaattttaaaattttctcaaaaaatgtttagagccaaaaatccatttaatgtaggatacaggcaaatttgtagcatgtttcaaatgctttctggtgagacctccaaaagtgaatgtgtctagggtatataaaattcttaaaggggctttgtcatccttcttccccactcacccataaaatagatgagataaaagctatttctaagggtggctcttttgtgaagtatttgagctttacggtagatgagactattgtttagtaaatatttgttccctctcctattacatcattgatgttcagctaggctatgtgacttccttttccctgagagatggcatagtgtacttccctacccttcgactgttgagttgagcttaactttctttggctaatgggatgtgagaggacataacccttatgaaaggcttgaaatgctctcgtgtgatgagtttgccttcttgtgcttttgccttctctatgagaaaaacatgacttagttggttgctggtcctagaaaaatgagatgcatctagagcagagccgccccagcatgtcttcagacctgcaacctccagcagagctgctccagccaagctatacgggcatggcagagaaataagctctttctgggatttggggttgtttgtcttacagcatctagctgactgctgcaagttcctgcacacagtggtgcttactcatgtttctgaaggaatagcagtttgtttatttcaaccatattgctagttatttgttattttccaccatattgctagggttataactctgaaaacaagttcagctacttctcacatgttccttctgcctgaaaactttgtctccttgctcttcacgtggatggctttctatctttggctctggatttaaatattactcccttgggatgacctcttctgatacattatttaaataccatctgtggtggagcctactatttacatattgaaacatctacattcccttttcttctctgaaataacaccttattttcgggggaaaaatttcaaactgagacaatagttggaagaacagtacaattaagttttccctctcctcgaatcgtttcccaatactttactgtgtgtgtcttgcaataaggaccttctcctatatgcccataatacgaccattaaagtcaggaaattattataacattgatacattaccaccatctaatccaaaggccccattcaggtttcactgaccatcccaataatgtcctttataatcttgcagggcaagattatcatagcatttaattgtcacgtcttattccggcagattcatcagtctctttgttactttcttgaccttgatacttttgaagatacaggccatttatgttgtataagagctctcaattggggattgtctgatgctttttcgtgactagaactaggtcgtgcaccaattctaggcttcaacaccccatgccagatctctgtcctatcccctctcgttgatgcttactttggttggtgccctttagtgactttaacactgaatatttgaggaagaataaaagatgaaacactgattttaattagggtgacatagactctgctttaaacaacaacaacaaaaccaaaaccctctaatttcccaatctctcatgaagctacccaagccatgtgatttagctttggccaaggaatgcaaagagaagagtaatatggacattttctcagaatgaggaccatatatttctttgcccatttttcctgttgttggtcttgaattaggatgcaatggctagatctctggatgccatatttgaccatgaagtcaagtccaaatgagaaacgatcattcccaaattaaggccgtgacttaaggaggtatataaaagagaaggtggcaattggttgaatgtagggtgtgatggagaaggactcaaagatgttgttcaggctcttggtttgggtaactgggtgaatggtgatgatattcatggagaaagtgagctaaaaattaggagtaaaattatttggaaggcaagttaaattcgtttttggaaagaaatgaatctgagatatacaatggacatctgacggtgttctctaaggtaacgggaattggaaacagatttcaatattgaggtggtagaagaaggggtcaaatcatcaaatcatgattctgttacttggaaggaaggctgaaggggagaccttgagcatcttgtttcttcttagttccatttatgctttatgcttttgagcactaatcacaacagatactgtggaggctgagctccagccattgtcaagcctgtgctccagcactggtataaattactggagtcctcattctagaggaaagcacggggacgaatcttttctagggctctttaccttgtctactcttcctgcagggagtagttcagactttcttcttctacctcctcttcttctttttttctttatagagacaagatctcagtctgtcacccatactggagtgtagtggcacaattataactcactgcagcctcaagttcctgagctcaggtgatcctcctgccttagccttctgagtagcttggactgcagggttcatgccaccatgcctggcttatttatttatttatttagtagaaacagggtctcactatgttgcctagtctggtctagaacttctgtcctcaattcatcctcctgcctcagcctcccaaagtgctgggattacaggtgtgagccactacacccagcctaggtttttctttcttttcaatgaatcataacccttctctcttcatttctagtgaacatgcatcaccttatcctatcacaaaccaactctgtgacaaatgtactattactatgcccattttacaaatggaaaaactgagacttaaagaatttaaattggctgggcgcagtgactcacacctataatcccagctcttttggaggccaagatgggaggattgcttgaggtcaggagttcgagacaagctgaggcaagaaagcaagaccctgtctccacaaaaattaaataaattagccaggtgcggtggtgcacacctgtagtcccagctactccacaggctgaggcaggaggatagcttaagcccaggagttcaaggctgcagtgaactatgatcatgcccattgcactccagcctgggcaacagagcaagaccctgtttctaaaaattagacaaaataccaagcaacaacaccaacaaaacaacaacaccataaaacaaagttaagtatcctggggttatactggaatccaaataatctggtttaagagcttaacctcctaaccaccatgctatactgccttgtggcaactcatgccttgtgaatctttactcctggtagtgtttcacagttgacagagagcttttgcattcttgatctcatttggtcctcacaacagccctgtggggcaggtaggaaagaccttgttattagacatgagggtcctaagaaccagaaagctaatggacatgccgaaggtggcccagccaatgaatagcagagttagataagaattgtgatcttcaggccgggcacggtggctcacacctataatcccagcactttgggaggccaaggcgggtggatcacttgatgtcaggagttcaagacctgacctcaagtctggccaacatgatgaaattctgtttctactaaaaaatacaaaaattagccaggtgtggtggcgcacacctgttatcccagcttcttgggaggctgaggtaggagaatcgtttgaacctgggaggcggaggttgcagtaagccgagattgcaccactgcactccagcctgggacacagagccagactgtctcaaaaaaaaaaaaattgtgatcttcagcagccttatagagcacttcttctactgtataatcctcgctttcctcatttacatctgtgaaaaagatattccttttgttcagatgctcttaggtgctctgaagcaagcaatagcccaagctggcattttgagagccatttcatggatggaaagcggaggctcaatggctaagggaattagccttggttctccagtgtgtctgcagtcttcatggcattggtgctgctgatccacagtcatgccagaggttgggtccgcagtgaaccgcttcacagctggatggttgggggaaaagagaggtctaatgatagaaaccttccccaaagcaaaggatgtaagcccacaccgagaattattagaaagaataatattctcccacactgagaattattagaaagaaagaaagaaaaactagaaagaaggacaaaggcattccagcatgcttcctgtgacagattgagccagtctttgtaacctcagattcacaaggacattgcaaagaatttcctgttgcgctcaccaaaattggctggcccttgtgccagagtcccactgacatccagaaaactattgcccatcttctctgggctgtgcaaggattagtgtcataatagatcatcacagccaaatgttattatgcaaagcagaaagctgcaagaaatggatcttcattcattgaatttgcatgtttggtggggactgcttcagacttcctttatctcgtgatcagtcgtgtgtgttgatcctctttgcaagttgttgtgagaactgggtgcagcaaaagctgccacttcaagagaccaaagggatttctgagatgaaaaagtgcatcaatttgcataaagaactcagataatttctaggtagaaagcaggtcagagaggctctagacctaggactctcgtgttggattgcttagtttcaaatcatgcttatgtcacttacatgcatgcaatctggataagacatttaatatctccccaagcctcagtgttctcatctgtaaaattagatgatgtggtgatgatgaaagaacatatataggctggatgcagtggctcatgcctgtaatcccggcattttaggaggatggggtgggcggggcacttggggtcaggagttgagaaccagtccggccaacatggtgaaactttgcctctaaagaaagtacaaaaatgagccaggcctggttgtgggcacctgtagtcccagctacttgggaggctgagacaggagaattgcttgaacccgggagacggaggttgcagtgagccaagatcataccactgcactgcagcctggacaatagagcaagactctgtctcaagaaaacccccaaaaaacaaaaaaaacaaaaataatatatataaaacatatatattatataatatataaaaaacatatataatataatatataaaacatatattatttaatatattatgtaatatctattttaataacatatattgtatattacataacttgttatattatataacatgttatataatatataatttgttatatatgttatataacatataaaccatgtattatatataatataatacatgttttatataatatataataattataatttatataatatatgacattatatattatatataacttatatatttatgtatgataaaatatatggtatatgaaatatacataattatatattatatgatataattatatatcatatatgtattatgtatatttcatatacattatattttattatataaacataagtatatattatactatgtaatagtataatatataattatacaatgtataattatatatgtaatagtataatatataatatacaatgtataattatatattatgatatgtatgacatacatatctaacatatattataacatgtatgttatatataacacatatagcatctagataccatgtatagcatgtgtacatgcatatatatttatgttattcaacatgggtccaggaatggagtaagagatcaacaaatacagtcattaaaatcagtgattcctcattcttctcccagctccttctttatgagattttgaaatccatatggatggataaaaatatccccaaatggtgcctaatgttgcagtgaaggaaaatgaaactctggaaataaaattagttcaaggagaaggagcatctccgctgttgacccggcttaacactagactaagaatagattgcaatggccccaacctcaggtatgccggataagtccctgaaggccctagaggggaacctgagaagggtttgaatgtttgcatgtgtgttcgacaagctggtacctggtagctgagatgtagaggagaatcattgtgccctatgtagagactggactatgtggactttttcatagctgtagacaaagacacgctgacagtaccagactggttttcaacctaatggcagcctcggggacaagggaaggtgaaaatggggctgcctatgaatggatgcgactcctcaggtttccatcagcctgaagtttggaagtgatctttggattaactgagtcggcagagtgttggaccacgagaaggcagatgtggagtgagatactggacttcttggctcctgtgagcaaagaggatgggcatgagattaaatggaaaagtaagagacgtgacagtttcccaggttaataacatgagtaatgccagttacatgcatgggagctcatttaacaactcttcagggttgtgttactacccaaaccctttatgatgctgagcacgcactgcagacactgattcctgcctgcccctccactctgtttcctggttaccttctgcctgattcattttgatctagacacactggcttccattcttttccatgaacaagccaagctccttcccacctctgggcctttgcacacgcagtttcctccacctggaatgctgctcccagatctttttacaacacatttcctctcatctgttgagcctcaccttacacgttaccctttcagaaagattttcccgttcatgtcctctccgctacattattctccctcccatcaccctctctaacatcatagtcctcaccattcctgaaatgatctttgttacttactgggtggcatgtttagaggctgctttccccactggctctgtgacagtgactttgtcatggtaactcaacattctgtttcctgtggcctgaagattgccgggtatatactaagtgctccatgaatatttgttggaagattcaatgaatcatatcttaccaatgcaatattggaagcctagagaaatgaaataacgttttcacaattgcacagagtaacagatgctttcagtgcttcccttgtatcttctaaccctttacctcttaagcatccactgacccatccaaatgtagttgcattctctttctgaggactttttctttttcttttctttttttttttttttgagatggagtctcactctgtcgcccaggctgaagtgcagtggcgtgatctcagctcacagcaatctccgcctcccaggttcaagcaattctcctgcctcagcctcctgagtagctggaattacaggcatgcaccaccatgcccagctattttttttttttttagtagatgtggggctttgccatgctggccaggctgtctcgaactcctgacctcaggtgatccacctgtcttggcctcccaaagtgctgggattacaggcatgagccaccatgcctggccctctttctgaggtctttttctggttgtactgtctttgcccacccgtatgatggcttggaagtcttggaggaatcaacacctgccctgggagcatccctccaccaggaactgatgagagttggtgtatgtggataactaccccatctccctcaccccttaggtcagataactatgaagcaagagctggtatgtgcatctttccccaagtccttgttcagggacaaggtagtgtgaaatcagccatggtgggaggatttacaccatggatatgggcagacactacaaatctgggcttttaatatttttctgcagtgttggttgttaaacatctaccagcacattgctagagatgttctacagtgtatcctagagttttccagcaagtttaagctccagttattgtcccaagtggtaacttgttttataatatgccctttactggctgcctccctgacctatttcatttcctgtgtcatgtttcatttacctcccacatagatgacttactcttggagtcttgtctcagggtctgattcttgggaaaccccgatgaaggcatacaactagtatgcgataaaaccagcatttaaacctaggaaggtctgactccaaatccacgtgtattttactaatactccactgcctcttgtgtctgaccagttctttgccaatacactgtgacaggagtcctttaaggagtgagacaaatgcattatattgatgaaagtagcttgcaattaagaagttagccttctaggccaggcacaggggctcaagcctataatcccaccatgattgggaggctggggcagggggatcacttgaggtcaggagttcaagaccagcctggtcaatatggtgaaaccccatctctactaaaattataaaaattagctgggcatggtgacgcacacctgtaatcccagctacttgagaggctgaggcaggagcatcacttgaattcaggaggcagaggttgcagtgagtcgggatcacaccactgcactccagcctgggtgatagagtgagactccatcgcaaaaaaaaaaaaaaaaaaaaaaaaaaaaaagaagttacgtttcttatgataagggatgggttaactagataaaacatgtggaaatctaatttagttagtaaattattttttatttcaaaaacacttttaaaacatagacatgttttccataaaacatgtaggcaccaagacagatttgattgctctcttgcgaatgatcagcagcaggcttccacttcatgcttgttataatttactgtttatagttcctaactctctgcttacacgctggtttgaatattcaagggtctcaccaagtggtgaggcactggacacaatgatgatgttgggtgcaaatgaatagggcttcagctggaaaggggcaaggggcagactggaaagagcttaggctttagacctctgtactggtcaggacactttggttcacaagggagagaaactcagtgcaagctagcctaggcagaaaagaaaaaagaacttaatgcctggggaaattggaaggttgaaggatgtgtagttagcttcaggtatggctcgatcaaggattactcgctaataaagcctctctccttcactagaatagaagctctgtaaagacaggcaccttgtctgccctattcatagctgcatcctccatcatatagaataatgcctggcacacagtgataataaaaattatagagcatgtcatatgggcatgccactgttcttagtttatccacttaacccaatgaggtaggcaattattaattataatccccatttttctgggtggagaaaccaaggcactgagaagtcatttagctgataagcagggtaactgggatttgaacctaggacctcttgctccagagtctgtgctcataaccatgctgctatattaactcagtaagtagttgttgattgagtgaatgaataactgactaatgatgaaacttgccagacacagagtattcagtaactaggagtgctgacatttatttgagtggcctctgttttctgtgtcccattagctttgggtgctggtgtcttcatctgcaggattccatatatttagcccagatcaatggagtgctggagggtcaggatgagtcgtgttcaagaaaataaggttggagttatttctagaattttttttttttttttgagacagagtctcgctctgtcgcccaggctggagtgcaatggtgtgatctcggctcactgcaacctctgcctcccaggttcaagtgattctcatgcctcagcctcccaagtagctgggattacaggtacccaccaccatgcttggctaatttttgtatttttagtagagatggggtttctccatgttgaccaggctggtgtcgaactcctgacctcaagtgatccactggccttggcctcccaatgtgctgggattacaggtgtgagacaccacacccagcctgaaattttgttttaagttcctgagatccaggggttgtttgttactgcagcatagtctaacccatcctgtgtagaagcccttacttacttaggatgtgtcattgagttcagagagaggcagtagaggaaagggcccagactttaaaatcagagagatgaaattccaactctccactcactagctgtgtgaccttgggtaagttccttaacctctctgagcctcactctgcattctcactagtgaaattacaactgtaattgctactccatgaaattgctttgactactaaaataggaaaccctgtcaagggtataacatagtaggtgttgatgtatgttggctattacttttgctattatgtagcaaagcatagattactttggctattttgaaaaaacctgttgctatcaattaaggatagagtggctaaattaagtaaattctgtaagcaaacaaggatgggtctttaattctcctccacttttgatttatggctgaagatttgacagttatctgaagtctgactagcttgaaaaccaagacatctgtgattagacttaccttttgttcttcccattagtgtaatacattgttttaggacatctctgccaacccactcccccaatatccatctagcttggagcctttatggccttcataaggacccggcttcccccttggtctttaaaattagacaacagatgttcataatcgaacctgtcttggttccagaaagtctgagatgttcagaaataatcagaacgtctctataaatatcataaaggatatatcattttggcagaaccagatccagtttttgtggggactgaagcttatataatatggggatctctgtttaagaaaaagaatacaaaattatgaatttaaaattaggcacaaaagagaatgttattttggaatgagaaattaagtataatattcctgtagctgcctggacatggtagctcatgcctgtaatcccagctttttgagacgccaaggtaggaggatttcttgagcccaggagttcaagaccagcctaagcaacatggcaagacccccatctctacaaaaaaaaaaattcaaaaaattagccaggtgtggtggtgtgtgcctgtagtcccagctactcaggaggccgaggtgggaggatcgcttgagccagggagttggaggctgcagtgagcgatgatcttgccaccacactccagcctccagcctgggggtaacagagtgagatgttgtctcaaaaaaataaaaagagaaaattctggagcctttagctatttccattccattcttctgggatctgtgtaggcaattaatcagaaatgtgaacatagaggtgcttcattattgaaacccagctttcccttctcacctaaagccttccccaagtccagcatttaaagagacaggtacaaggaaaagaccctgaagcccaagcctcattagcttcaggtaaattcacctccgctctctggagaagcagacaacagaggcctcttgtgaatattgaggagaaggttgtatgtgtgttcatgtgcgtgagatccaagtggagagcatgggaacctagctcaattttcccttgaggtgagcttgaagctttgggtatcttcctctcagagaacgtaaacccatttttccaacattgttgtaaaatattctgttcccacctttcccacaatcagcttgcctgaccccaccacagggtgtgtcatcttgtgcttctggcacacacacacacacacacacacacacacacacacacacacacactctcagagccctgccatctgaaggcagccagctccagaaaggccaacccttagctgtaactcagcatagcactgttcatgatctttggtttccatttctaggctggtttccttttttgttttgttttttcctttgccaagactgtagttgaaataggataaaggatttatttttccataacaaggtaggagaaagggtgctaggttacaagcaccctgtcaatatcagagttggaagcttcttcctaccatcaggtgtgtgttgtgaaaggaacgaggggttcaggcaagtatttcccagcaggtgggaaggggtcttgatgggatggaaactaggaaaacaaaccagattccctgagggaaaatcaactgttcctgaactgttatcagtgtgggagtagggttcacagatttcatattctaaacatgtttgtgtgtggtgtgtgcacacacacctactatgtggcagagcctgtcataagtggtgatggattcctgtagatatagtttgctggagctgccataacaaagtactacagactgggtggcttaaatgacagagattaattttctcacaattctggaggctggaagtctgagatcagggtgtcagcagggttggttcctccgaagacctcctcttggcttgcagatggtcgattctggtgtgtcctcagatggtctttcctctgtgcctgtccatccctggtgtctctctgtgtgtcctaatctcctcttcctataagaacacgagtctgattggattagagctcaccctaaatgagctaaataggtttaaacttaatcacctatttaaagcccctatctccaaatacaatgacagtctgaggtgctagggggttaggacttcaacatatgatccatatggttgaagggcttcaaattcatatatatatatatatatatatatatatatatatatatatatagagagagagagagagagagagagagagagagagagagagagagagacagagagacagagagagagagacagagtctcgttctgtcgcctaggctggagtgcagtggtgcgatcttggctcactgccacttccacctcccaggttcaagtgattctcctatcctggcctcccaagtagctgggatgataggcatgcgtcaccacacctggctaatttttgtatttttagtagagatggggtttcgccatgttggccaggctggtctcaaactgctgacctaagatgatctgcccacctcggcctcccagagtactgggattacaggcatgagccactgtgcctggcctcaaattcatatttgaacatttattcaaatttgaattttagggggacataattcagcctgtagcactgtcaacctaaaaggaagaagctgaggcaaaattaatgtaagtaaagactctgtttgggccaagcttgaggactgtagccagggagcgtagattcaagtttccctgaatatacactccaattagcagcagttacaagtggatttataaaggcaaaaaagggggacatggagtgggctggtacacagttggttgtcaggaattctcactggttttcagaaataacattgacgagtgattggctatacattgttaagctatgaggtgtgggttatagcatccagtggggcattattagattaatttatagctacttgtggcaatggcaagcagttttaagaaatgaataccgagctcaaagggggtatgtaggacatgattgctatctcattctattgcctctctgggcctaataatttaaaaggcttgtattcctcagatgaaagttctgttcttttctcagcaccttgaatggctggagagagcaccaccccatccttgaccatgctgagtgctggctggacttcaactgggccagtactcccttttcccttgtggaaggtcccctgattaatgcttacctgaacgcctgctcttccttcagtccccagttctctgcattccccagcactgggaacagagacagcatgtctgtgttatacaatagggaagagtatgggctctgggtttaaactttgactctgcccccttgttagcccagcgactgtgagcaagtcatttcacttcacccaacttgttttcctttttgtacattggaggttactaaaagcaccttacctgtccaattgtagagaggattaggtgtattaatgggcatggcacagtaaacactcacaaaatgctagctactattaattgtcaagattatgttggttgcaaggagcagaaactcatatggaagtcatttaggcaataaaaggggataatttattgactctcataaccaaatccaggaaggtaggagagcagttgagtggcaggggcaactggaaagagaccattccccatgtctgtctgtctgtcatatcttttttatttttatatatgtatttttttaccatggtgggtttttttttgtttcttttctttttttggttgttttttccatccttggctagaaccatggctgccaacaagcttctctgtttcataatgggagaccttctcatgtggttatgatgtgaaaaaaatcccagggaaggactctgattggttcagctcaggtcacatagccacccacgtggccaggtcaggggctggggtgcttaggtggggcagggggttctgggtagataaaaataattaatgccttctgccttatctaaatgttctttgtactatgcctggcacttggtagaaattaaacaaattcccctttttccctttctgtttgaccctcatgtctactttttattacataaaagagtaatccagaaaagaaagtcagctcattggagacactgggtagggagaaaaagctttttatagaatattaggtaggagtagtggcttaggatggtaagagctctgcacgaaaggaagacattacggtctaaggccacctgggagatctgagtcaagcagctctatcccttcctgaggacaaaagagatttcaggcaatgactcatttgtttggagagctaattgacaagacatattaagagttttagcaattgttcatgctttttgatccaacaaattcacttctagagtgtcaagaactgtgctggtctaagatattatcctacatggaggctagtgagttttatggatgtgggcagaagacatgagactctggattgagagataaaggactttatttttcatggcacaacaggaagcttgagcttcatgtctgcaccagttccctttgacccccaagtccctcaagggtgacacaggttgacatggtttggctgtgtccccacccaaatctcatcttgaattgtagttcccacaatccccatgtgtcatggaagggacccagtgggaggtaatttaatcatgggggcagttatcttcatgctgttcttatgatagtgaatgagttctcacaaaatctgatggttttataaggggctttttcttcttttgctcattcttcccctttctgccgccatgtgaagaaggacatgtttgctttcccttctgccatgattgtaagtttcccgaggcctccctgagtcaattaaatctctttcctttatgaattactcagtctagggtatgtttttcatttgtttgtttttttgttttttttgagacagagtttcactcttgtcgcccaggctggagtgcaatggcaggatctcagctcaccccaacctctgcctcccaggttcaagcaattgtcctgcctcagcctcctgagtagctgggattacagccatgtaccaccacacccagctaattttgtgtatctagtagagatggggtttctccatgttggtcaggctggtcttgaactcctgacctcaggtgatctgcccacctcagcatcccaaagtgctgagattacagccatgcctagccttttttttttctttttttgagacagagtctcactctgtcgcccaggctggagtgcagtggcgcattcttggctcactgcaacctccacctcccgggttcaagcgattctcccacctcagcctcctgagtagctaggattataggtgtgcaccacaatacctggctaattttttgtattttagtagagatgaggtttcaccatgttgcccaggctggtctcaaactcctgagctcaggcaatctgcccacctcggcctcccaaggtgttaggattacaggtgtgagacaccacacccagccttgggtatgtttttattagcagtgtgagaaatgagtaatacatggatggatccaggtagaatctgtgcctgcagtggatttgcatcacacctgaggaaccccaagtttaggaatcttggtcttttcaacctttaccctggatggagggagacattgtcattataatcctttctttttctttttcttcttctttttttgttttttgtttttttgaggtagagtcttgctctgtcacaccaatgttggagtgcagtggaatgatcttagctcattgcaacccctgcctcttgggttcaagcaattctcccacctgtctcccaagtagctgggattacaggcgcccaccaccacacccagctaattttttaagtgtttgtagtagagatggcagtttcaccatattggccaggctggtctcgaactcccaacctcaggtcatctgcctgcctcagcctcacaaattggtgggattacaggcatgagccactgcgcctggtccggagatattattattataatcctaatcagcaaataaatctgtcttctactatactagccctatcttctaatgctattagctatacaaacatccttataaagacggtctagaacaaaagctgacacaagatgtgcagaaatgtaagagacacatggggaattgttgcacagcatagagaatctttcctaaggaaactacatctgaaacacacacagaaaatgtattcttaaagcaacaatagttcagcattaggggaagaggttaaacagactgttgttgggatactcttctgtttctaaacatgtttctgaagatcttggaatgggaagtgtaaacgttcaacttaaaatgtaaagtggaacaaaaagctgcaaaacttgaatatatgtttttattaactatgtacagacatctattctaggaaacctgggagggagacgtgctaaaatgttcatagtctttctctgggcgatgagtctaggatccactgtttttcttcatttggaatgttcatagtcctcctctgggcaatgagtctaggatcaactgtttttcttcatgtggaatgttcatagtcttcctctgggcaatgagtctaggagccactgtttttcttcatttggaatgttcatagtcctcctctgggcaatgagtctaggatcaactgtttttcttcatgtggaatgttcatagtcttcctctgggcaatgagtctaggagccactgtttttcttcatgtggaatgttcatagtcttcctctgggcaatgagtctaggatcaactgtttttcttcatttggaatttttttttttcagtttttctataatgaacatgtattacatttataatagaaaataacaagataaattatttctgaaagcagtgcccagcatccagaatttggcaaaaacaggagaagaaagcataaaacaagcagggaaaaaggttttcagttaaattagatgtccaatgaagagatcagcttggctgcaaaatctctttttgacagacaattagttctgggcaagtcaaatgtttcaacagtgcgttcttctggggcaattaaagtaattcatacttgatgtgcggaaatgtggtaattgggaaagttccccaaatggcagttgaaactgggctggttgtgtttggagaagttaagtcatgcccttgacaagccatctatctgagtctactgaagagggcttgggctgggtgattttaagatggaattttccactgggcataggaagtgatgttgggaatggactagaagggtcaacagtgacaacattaacagcatttattgtaatataaatacagttggcccttgaacaacatggatttgaaccgcatgggtccacttatacatggatttttttctgtttttgccacctctgagacggcgaaaccaattcctcctcttcctcctcttcctcagtctcctcaatgtgaagacaatgaggatgaagacatttatgatgatccacttccacttaatgaataataaatacattttctcttccttatgattttcttaatcatatattgttttctctagcttattttattgtaaaaatacagtgtataatcatataaaatacaacatatgtgtatattgtttgtgttattggtaagacttctggtcaacaataggttattagtagctacgttttgggggagtcaaaagttataggtggatttccaactgtgagggggttggcatcacagtcattcatgggtcaaccattgtgtcaataacaatcataccacacatattttgagtgccacatgttgcactaagcacttatgtatctattaatttctacaactatcccgtgcaatagatacgattggagtttccgtcttactgataaggaaactgagggccagagaggtcaattgagttgtccaaggtcacacagccagttagtaatggagctggaatctgaatccatgcaatctgacccttgttcaatgctcctagacttatgtgctggatttttttttttttgaaataacaatgttttatacctctatctttactttcctagataagggcatctgatttccctccatggcaagcaagttatgttgtatttgctacatttgagagggaaaaaagctgaagttcagaacggattagaaatttcccaaggccacacagtgaaagaatagaaagtttccttttttaaatggcggagcttttatatcaatgctgtttgtaaattttagttggcaatgtctgttatattccatgaaactgaatgagaggtgaggtggtatattagccaaaactctctcagctacatcttgctattgttccatgcaacttcaaagcccacagatagactggacttcaagtatggctggatccagatgcttaaatgatatgctttgaaatctgtctgatctctacttctcagctctcttttcatccatgttggcttcattatcaggcccttttcttatgccatcagcagctgctgacttacctcctaccagcttagtaatcccaggggaaaatgaacttacctttgccaaaagcactggcataagaagctgactctcattgcattgtaagagtcaggtgcccatctctgaacgaattattgtggctaaggaagtagaagagggtgattagtcagtcctgatcatgtgctcagctctagctttagaagatggtgctatccaaactccatgaatgaacagtgaaggaaggaccattgttcaaaagtaagtggaaatgctgtttccaggaaagcagaatgggaggaggaagtggggggaggggggaagggattcaaggggtgggagctggaatggaattagccctaaatagttggagtttggagggtgtaagtaagtgtgagctgaatgccgaaagcagagttgcaagatggtgtgtcagcccagttctgagaaacaaactcccatacaggattacacatatgtgatttttattaagggaaatgcccttgagagaaagcaaagaaggtgccacataaagctgggagaacctgagacagtaatgcaagtctgactctgagtaaaagagagaggagaaaaaagttagggtgcgaacaccatagggaagtccctaagccaaagccggggacaggggaatcctgtgtctcccggggaggggtctgctttagtgtccctgccatgctcagtcattagccaggagcacctcatggaaggaagcatatggattccccagcgcagcagctggggccctggttaattacactcccagtagagggaggtcgatgaggcccattctcagggccaccacatggtgagccatgcagcagtggcctggcagaacatttgtctgggttcatacagtatttacattaaaaaaaatcagggctgggtgctgtggctcacacctgtaactccagcattctgggaggccaaggcaggcagatcacttgagattaggagctggagaccagcgtggccaacaagggggaaacctcatctctactaaaaatacaaaaattagctgggtatggtggtgcacccctgtaatcccagctacttaggaggctgaggcaggagaatttcttgaatgtgggaggaggaggctgcagtgagctgcgatcatgccactgcactccagcctgggcaacagagtgagactcttgtctcaaaaaaaaaaaaaaaaatcagttgccagcattcaacaaactgtgtattttacatctttaaaaacccctggatttcctgcttctctttaaaaaatagtggcagtttggcaacattgggagtccattccacaaatcttgcaaaattgagtcctcgctgcctccttagataaggtgtgtgctctctagtttgccacagtctccaccagacccagttgccctaatctgtactcttcactcatttgtgttacttgtctgcccatgtgtgcatttaagtttgcaacccttgccttaaattcatctgagaaacaaactatggcagtcaggttcagccatagaatctaatgggaaggagcaaagctggagattgagcgactaagctagaggttgataaagcaggaatagagcaggtagctggagtctgagcagacagacttcagggcttgtctgccttcctaagagctcctttgctggctgggtgaagtcactgagaacctaagcagagggtgtcagttctagccttcctggagaaatcttagttgagatggatgtttagagctggtggacactgcctttgtgtcaagccagtctaggagtcacagcaatatttggacactggttgaaagttgttccattccatcccacttgctcagcaatttggacaagtgtgggtttaggttattttaattggttaatacccttttgtttaggtgctctcctttcctcttccacatggttcagtaaggctgccaattctagagctctttcttctcctatgaaagtcatggatgtcttaggctgggttttcccagaggcagatcctgtgatgaggatttccatgtaatggtttatttgtagggtgactctgggaagcaccagtaggagaatgggagtgtattagtcagggttctttagagaagtagaaccaatagaatagcacacacacatacacacacacatatgcatatacatacacacacacacacacacacacatatataagcatatggggaatccatatgcttccttccatgaggtgctcctggctaatgactgagcatggcagggacactaaagcagacctctccccaggagacacaggattcccctgtccccagctttggcttagagacttctctatggtccatatatatatatatatatatatatatatgtgtgtgtgtgtgtgtgtgtgtgtgtgtatacacacatatacatgtgtgtatatatacacacatatacatgtgtgtatatatacacacatgtatatgtacacacacatatgtgtgtgtatgtgtgtatatatatatatacacatacatatatgtatctatatgcacttttatatacatacattcacatacatatatgtatctatatgcacttttatatatatgtgtgtgtgtgtgtgtatgcaattatggaggctgacaagtcctaagatctgcaggatgagtcagtaagctggagacccaggagacccagtggtgtagttccagtctgaaaaccagcaggcttgagatccagaaagagccgtgtttcagtttgagtctaaaggcaggaaaattttgacgtttcagcttgaaggccctcaggcaggaggagatctctctgactcaggcaagggttggccttttgttctatttagaccttcaactgattggatgaggaccatgcacatctggagtgcaacctgctttcctccgtctacccatttaaatgttaatctcgtctgaaaacaccttcacgggaacacccagaataatgttttaccaattatctgggcactcagcgtcccagtcaggttgacacataaaattaaccatcacagggcaaaatgagacaaggaaatctaaaccagaatagagcaaggtaatgagtaagttacttctatgggcagccggggcttggtccttttgatgggctttggttgatggcatggaacacacctcaaattgtcccacctgagtgttgagaaaactgagatatttatctttcatcactcatctgacattgaccaagggatgctctcagggactttgacatccttgaacttctggcctgtcttgccgaggccaagaaaaggccttcaggtggggagttgcaggtgcttgcagagggatgccttcagcttgtatgggatggggagggtccaagggacatgggtggccattgccagtgtctgctatggttggtaagtggcacatatctggtcaaacatcaggatctatccacccagcagtgttggaccttggagtggcacaggcatcagaatcttccctggggattaacttattgtggttcttgaacagagaggatatatatctggaggtgccagcctctacttgccctcccacatggagagagatggagaataaggctgagcaaagacaaacagtgaagagaaatggagacagagagagggagagagagagtgagagagagagagagagacagagagagagagagagagagagacagagacagagagagagagagagagagagagagagagagagagtatacatgtactttgaggcagtgagtcctgtttctagtccctggggctctggttcttttctcttcctgtcttagtctgtttttgctgctgtaacaaaatacccaagactagataacttataaaggacagaaacttatttctcaccgttctggaggctgaggagtccagggtcaaggcacaggcacattttgtgtctggtaaggggctctgttccttgcttctaaggtggtaccttgtgtcctctggagggcatgaatgctgtatcctcatatgtggaagttggaagggcaaaagggcctaagttagttccctctacccctttataaggcatgaattcattccttaagggccaagccctcctgactgaatcacttcctaaaaggcctcacctcttaataccactgcaatgaggattaagtttcaacatgaattttggaggagacacgttcaaaccttagcattccctttccgtaaatgacctcagctggataaaccagtatattcgtttcttgattaatttagccagagttagatttctgggcatgcaaccaaaagctcttactaacagttattgtggtgggatagggatgaggggaagggagattgggattgagagagagattgccctgggcctaagagctttctctccttattacatcccagtgcctgagatttaagttgctagaaggaagatgagtttatggtggaaatttgtaaccgaccattaactagaatggcgcagctaagcccctgtgcctgaccaattgttaggacttaaagaaatagcaataaagaaagagcttttagtttcagagcttaattagccattcttttccttcctgacttttagttttatgactctagcttccaggatagaattttattgtagtcagatacaaattaaacccaaacaaggactctcccgtgtttctgtttcttcaatttaaatttattctttgtagggtgacactaagtaccacagtatatgtcacatgtaagaacagtaaatttttaaaaaagagagacagggcaagcatttatcattgtgatctcttctctaaacataatgggaacttaggttaattaaaaaaaaaagttaatgccgttgttttttgccttaagaaaggtagggtttttatctgaagtgctctgagaattggcactcttaaatctgcaatgatgagaaataacagtagctaccatttgttgaaaatctattagtagtatgctaggtccttaaccttcagtatctctaattaccccaagacacttgaaggatggatggtctaaagtttccatgtgtgcaaaatgatagctctgagaagacttaaccaatgtttcaaagatttaaaaaaaaaaaaaaaggaattggagccagtttgcattaagaccttttgaactccaaaaaatctatctatgtgcttccgacttgaaaagggtatgttttgcatgctggatatgggtttggtggaggtgctggtgtatacactgtatgtttcaatgctagacatcgtgctgggtactggacttagtaggcacctgatcgcatttctgttcggcaaattcagaaaatgtgagtgactgaaacttcattaggttgaaggggaatttaccttttcactacgtctgagcaaagggtttattcggtaaggtatatttatattatattatattatattatattatattatattatattatattagtgccccatggaaattatatttgtttctctacagataacaaagattcttatttctctcttaaaattcaaaataaagagccttactgacatctaccataaatcctctgctgtaaccaggtagagtataaataactccataaaaagagagtaatgctgtcttgcgtttgcacagcactttacagtttagaaagtatttgcttgccatgtccctttcgatcctcctgataggcttgcggggtaggaaggagaggtactgtcatttccatcttcctggtgggaaacaaacatttggagaagttgggtgacttgccccaaggtgacacaatagtgaagggttcaaaccaggacttagttagtttgggtgtcagaatgggtcagagtgggtttgtcttagttagtttgggctgtgtattagtctcttcttgcattgttataaagaaatacctgagactgggtaatttataaagaaaagaggtttaattggctcacagttttgcaggctgtacaggaagcatagctgaggaagcctcaggaaacttacaatcatggcagaaggtgaaagggaagctggcatgtcctacatagctggagtaggaggaagagagcaaaggggaaagtgctacacacttttaaacaaccagatcttgtgagaactcactcactgtcatgagaacagcaaggggcaagtctgtccccgtgatccaatccccttcccccaggcccctcctccaacactggggattacgattcaacacgagatttgggcggggacacaaatccgaaccatatcaggctgcaataacaaaatagtataaactggatggcttaagcaacagaaatctatttctcacagttttggaggctgagaagtgccacaatctggctgatgtagctcccagcggaccctcctcctggcttgcagaaagctgctttctctctgcattctcacatgacggaggaagtggggggtggggggagcggaggtagagagggagagagagagggagggagggaagaggagagacagagcaagagagcaagccgtctggtgtcttttcttgtaaggatgctaattccatcacgaagacctcatcctcatgatctcatctaaactaatagtcttccaaaaaagcccacctcctaataccaacataatggaagttaaggcttcaacatatcaattttgaggggacacagttcagtccattggacttagagttcacacttcctggacaagattttggaacgttgtaaagctttcttcagaaaaacaactagtttattttcccccaagcatttatagcccactttagcagcactcaactgcatgcctctgatctatatgctaattttggatccgccttatctcttaagtaatccaagagtttgtgtgtgtgtggatgctccttgatttgaaatccttatgtgcttagaactaatggcgttgtaaaacacactccacaatgtacccttctctaattcagcctgattttctcccatccctccacgttagccgggctcccatgcccctgtttttgatcacgattgattgtccagctccaaagcatcatctgaacgacttatggtctttctcccgagtgttggagcccagggtaggcagatgggagagggtaggggatttgaaccggagaaagacatttaaatttcctcctgttcatcttagcttaggaagttacctgctgtctgaagggtgtatccctattttattatttatttatttttacaaaaccaagggaaaccagcaacgaaacgcaagaggagctcctctgcctctgattccagtagctgtgctctcaggttggagcagccaacccagaaattggtggccagtggctagggtcaggatgagcagagtgaacgcgagttctatgtctgattataaaaactgtacttgctccttatggagaatttgaaatctagggaaattataaaaatgtaaagtgttatcagtcctttgtcagccattgggctggttggttggtcagaagtcatcactgttatagaccctcattgcttaatgaaaattaatttgtcaagcgatttccttgatgatgctaatatttattgaaaggttaccctaggctgagttctggctaacagctatatatatgtatacttttattttccaagtgaagaaacaggctcagagagggtaagaacttactcacagtcacacagcaactgagtggggcggctagaatttgggttcagatagtcagacgttagagttcaggtttttcatcccttcaacatctacacatttttcaagaaataacaagattcacttttggtttgaagaggagtgcatgggagagaaagaaaagtaccaaatgggaaaaagagagagcaaggaaaccaaactccgtttgtggtcgtgagctacattaaaaaaaaaaaaaaaaaaaaaaagccaggccagggacaatggctggattatgcctgtaatcctgccactttgggaggccaaggcaggaggatcacttgaggtcagaagtttgagaccagcctgggtaatatagcgagaccccatctctacaattcttttctttttcttttttttctttttttgaattagcaaggcgtgctggtgtgcacctgtagccacagctactggggaggctgaagcaggaggatcgcttgagcccaggagttcaaggctgcagtgagctatgatcccaccactgcactccagcctgagcaacagagtgagactctctctgaaaaaacaacaacaacaaaaacaaaaacaaagcaaagctggtggtttcacatgagtgttgctccttctggaaaggcatcactggagtgggtgccatattttgatgctgctgctgccaatgatgagaacatgggcaacctcttttgcctgtaattttttttttttttttgagacagtctcactctgtcacccaggctggagtgcagtagtgcattctcagctcactgcaacctccgcctcctgggttcaagcgattctcctgcctcagcctcccgagtagctgggattacagccgcctgcatccacacccagctaatttttgtatttttagtagagatgggattttgccatgttggtgaggctggtctcgaactcctgacctcgtgatccgcccgcctcggccttccaaagtgctgggattacaggcgtgagccaccgtgcccggccaagagagacttttctacactttgtaattatgttatttttaaactgaaaactatatttcctatttcttagtgttagaaagaaagagaaatccctgagaacaatcagcagcctggagcatagtttgagactcccactaacagagccaagagtctcaaactaggccaacagatacccttggggaaccctgctgtatccctgggacataaaaaactacagtacaaacatcatcatcttcctggaggatgaataaactttagtagagtaatagtaacttaaaacacatgtggcacaaaatagaacgcagagttcacaaatacctaaggtaaaataagacttcaaagaaaatttcacccttgcagaggttattttgggctacactccacagagtatgaattcattctcttttcctctcagggatagtttgttaagagtctgaaaaccactgctctgggcaaactgccctccggagtcacacacaaaaaatcaatctcgttactaaagataaattttatttcaataaaaattgtaatgagcttgatcacctacccttttcacctgacttggctacaaatgactgccaactgtttaaaaaaaaaaatccaaccgaccctcagagctaatatgctattacttttaaagattacagacaggccaggcgtggtggctcacgcctgtaatcccagcactctgggaggccaagttcctatttcttagtgttagaaagaaagagagagaaatccctcagaacaatcagcagcctggagcatagtttgagactcccactaacagagccaagagtctcaaactaggccaacaggcacccttggggaactctgctgaggctgaggcaggagaattcccggaacccgggaggcggaggttgcagtgagctgagatcgcgccattgcacttcagcctgggcagcgagagcgagactcggtctcaaaaaaataaaaaaataaaaaagcctctcttgtgtccttgtccccagccttccagctctcctctgagggaaccagttttcaagatggcccgcaacaatccctgcctgctgccattcacaccttgtttagtcccctcccacgctggaaagatccatgttggggctcgtgtgtgaccaatgccgcagaagtgatgttatgtcacttccgcgattacgtcatgaaagactgcagcttccattgttggctctttctttctctttcttggatcagtcgctttggaggaagccagctgccatgttttgaggacactaaggcactttacggagaggcccacgtggtgaggaattgaggtttctaagagccagtaaggaatagagacaaccacacagtgagcctggaagcctagtcttcagccccagaaacgctcagatgactgcagtcctggctgacatcttacctgcagcctcattggagaccctaagccagagcacttagctgagttggcttgtgggttccaaatccagacaattagatgataaatgcttgttgttttatatttagttttagtttttgtgactacatcgtaggtgtatatatttatgggttacgtgagatattataggcatgcaatgtgtaattatcacatcaggctaaatggggtatccatcatctcaagcgttttcctttgtgttacaatctaattattctcttttagttattctaaaatgtacgattaaattgtttttgattatagtcaccccattgtgctagcaaatagtaggtcttattcattctttttttttttttttttgagatggagtcttgctctgtcgcccaggctggagtgcagtggtgcgatcttggctcactgcaacctctgcctcccaggttccaggaattctcctgcctcagcctcctgggtagctgggactacaggcgcctgtcaccacgcccggctaacttttgtattttttagtagagacggggtttcaccatattgaccgggctggtctcgaagtcctgacctcgtgatccacccaccttggcctcccaaagtgttgggattacaggagtaagccaccgcgcccggccttattcattctttctaactatttttttgtactatcatggttcactgcagcctcattttgacctcctgggctcaaattgatcctcccaccccagcctcctgagtagctgggactgtatgcacatgccaccatacctaggtaatttttaaagattcttttatagagatggggtcttcttatgttgcccaggctcgtctcaaactcctgggctcaagtgatcctcccgcctctgcttcccaaagtgctgggataacaggcgtgagccactgcacccagtcgatggcgtgtattaaaaggaatgatgatataaatactgatgactaacatttattgagtgttttttccatgtcaggcattatatcaagcactttacatgcatatctcatcagtaaaacatttgcatttttatttcttatcactagtaaatccttctcctcccagaagcatttaaaaatccacaaaccatggctaacttcctgtgaaatggcttagtgggcaaaaattcagaataaggggagtgtgagtccatgtctcctttccagagatgaagaagtttctcttttctgtgcatgaagaagacaatgggatatggatgacactaaacctttgaaagttcctgctaacctccaggtggaaggaaagggcccacggtgatcaataaatgtgtttgctattttttgggtgaaaggaagagagcctgcacctctgttggggtaggttatccacgctgtctgcctggggtccagattcctggcattgatatgacttcttggctctcttgagccctgaatctgcttcaaattcagaaagccccaagacttctgggctctataattactctgggctttggagaatggtttctcttatgagcaaaacaatggtggaaacttgtaccaatgaaggaaacacacaagcgtgtagaggaacattgctgtttgctgatgatgctggtggctgcttgggtgagagataaactctccaaagagcgttggcccttttgtggctgcaggatctgggtgaaagagattcttgtagtctatcctatcactagatactatctgtcttagtccattttgtgctgctataacagaataccacagaccaggtaatttacaatgaatagaaatttacttgggtcacagtcctggaggctgggaagtccgaggttgagagcttacatctggtgaaggccttcttgctgcatcatggtgtgacccaaggcatcacatgggtgagagagagggtgagagagagcacctactcctgtgaaaaccagcccgctcccatgataaaggcattaatccattcagaaagatgatgtccccatgatccaaacacctcttgaaggcctcacctctcaacacggttgcatcagggattaagtttccagcacttgaactttggggaacacatgcaaaccatagcaatatctgtgccggatattttgtatttgctcctttacatccactgtccacccccatttcctgctttgtaccccaggaggctgacttctatggactacatcacatgtggtctcccatcctcttgtggctgcttgggtttggccaatggggtggggatcatagaatactagaaggtgggaggagagagggattcggatatttatttctgtggctccttcctgttgggttgccataggttggaagctcctgccaggcagctgtctttccctgaagactgtggctactctccttgggttccataactatttctcctccaggtctaggggtagaaatggctcctcactgctgctagttagggctactgcaacctccctttttgtttttgttttttttaatcccacttatacagctatatatagccctttgctaaactctttttagttaccccatttgagtttactatgtatttcctgccacaaccttgattgatacagcagcccagagaagggaagcaattaactttctcactcctttattcattcatccaacctcccatcaacacttactctatgccaggacttgtgctgaggcttttaagaatgagacatgatttcttgtctatgtccctgagttctcagttgttcaccccagaaactgactcttaccaaagaaagagaacatgccgaaggcattgctgaaggcccagccttggaaaacaccccatacaaggtgactccagatagctttatagcggcaactcctccaagggcatgcgttagggataggctgatctggggacccctgctctccctgcagagaattcatggaaacccaatagggcctgtgttcttgcatcatgagtcaaggtgccaagagagatcacctgattggctgatccagagtcacacggttgggggagggtatacaaagtggagggctcaccacagcggtcagagataaggctgctccttgcagctctgttttttgcaattcctcttggaccctccccagttcggccaccacccttgaggctagcaagggtgagttgtgtcagaagcattccatgcaaggaaataacaacttggaatccaaatatattcattagtaagtaatggaaacctgaaattgcttaaacaagatgggacattattctctcacattaaaaggaatttgggggtaggtgagtctagggttggtttattcagtagttcagttgtatcatcaaagacctgggctcttgccatctttgtgctctgacttacagagcaagggcttaattccagtcttttcctctaatgagcacaaaatgggtgccacagtgccttacatcacatcctaacacaataacgttcaatgtccaaaggtcagaggagaaaatgtgtcttccttgtgtccattgttgacagcaaggaggaaatttccatcaactctcattggtcacaatgggtcacgtgcctattcgaaagcaatcactagacagggggtcagtattactatgattagtttaggtcagtcaagattcactccttgaggctcagaagggcaacttctcctaaagcatgtgactgttcaatactttaaaaattggggttctcttagcaacggagaagagaggctctttttttgacaagcaatcgtagcatctatcaaagcataagaaaagcttgtgagtgatgaggttggagactgagaaggttccagaacatgacattctggtgaagtaggcaggacccaggaatctcaaaagtgacccaatgtcacagagtctgttggtggcagaggaattgaggcatctagaggcatctaggcagagtgattgaggcatctcactttctacgcagaaaaggaggcatttgctccacaaaagcctcctgctaattccagggacctttcgctgtagagacaactttatggcatcagtgacaactttggcctcattgtcctgacagagcctagaatggtgctatctttgggcttcatatctgtgaggcactcagaaatgtatgaagcatttccaagtccatggtctcatttgctctccactttgcagtggggaaactgaggttcagacaggtgaagagacccgatcaaggtcacatagctggagagcaggaaacactgagctcaaccccagatattttaaccaaaggttttagttctctgccttcctgccttctagataactccatacagtctgcagggtagatcctcaatcatgatgtatgaaaagcgtgaatgaatgcaaaaaaaaaaaaaaaaggtttaaaaaagctgtgcaagctgggcacagtggctcacacctgtaatctcagcaatttgggaggccaaggtgggagaatgtcttgaggccaggagtttgagactagcctgggcaacatagtgagactccttttctataaaaaatttaaaaattagctgggtatggtggtgtgcatctgtagtcccagctacttggaaggcctaggtgggaggatcacttgagcccaggagttcaagaccagcctgagcaacctagggagagcccgtctctacaaaaactaatataaattagcaaggtgtggaagtgcatttctgtaatcccatctacttgggaggctgaggtgggaggattgcttgggcacaggaggtcgaggctgcagtgagctgtgatcacacaactgcacttccagcctgggtgacagagtgagaccctgtctcaaaaaataaaaaagttgtgcaaagataaaaacccagttatgactcccattgtggacccataaataaagcaaagttatcaaatagagatgtgtgagctgctgaatggaacagaactcactgggtttatggggctgtgtcaggcacctctgacaatgccagatatttactttgcagatgaatgacttcattgcttgccccaaatgcatcactggtgggtaatatttatgcagattggaagcattctccctcctttatatggtcctgggctgtttgtaaccattggatttttttaccttttgacttgacgttgttcttcacgggaccgtggtatgggatgcatttcaataaacaataccaaaggacagatttcggctttaaataaaattgtgttccgtaaagtgggagacaaaggcttataactcactgtcggctgcagacattttggcaaaaattatctttcaggctttgatctccactgtatcattttactgagtggccccatgtgctctatcaatcaaacccactgaagatgcaggagaatcacatttaaaatcaaatacaaattgtagattcatctgcccaggaggaagagaaatgtgtcatgaatcctgccttcagtcttctatgattacaacggaattagtttttgaaaactccagaggatggttttccacttcccaactttcatattattattattatttttgaagggggtaacattagatgggtagagaggtagactaaagtgattcagctgtgagatcggagtctcgccttccatctaactgtaggttagggccttttaatattcctctgacagagattctttatgtaggaagggatgttaagaagaaagatgttctctaacaagaaaacatttagacaaagaggatatgacctccctcactcaatctcgcctgctttcttggcatacatgggaagagaggatgaactagaaaggaaatattatttgctgatctcctttctttgtctgaggcacattgcacaggatgtctcatttgatattcacatgcccatgtgaggtgaacaatccacaccatgctttacagaaggggaaactgaggtcaagaaacatgctcatgggccgggcgcggtggctcacacttgtaatcccagcactttgggaggctgaggtgggcggatcatgaggtacagcattcgagaccagcctggccaacatggtgaaaccctgtctctactaaaaatacaaacattaggccaggtgtggtggcatgcacctgtaatcccagttactcgggaagctgagacaggagaatcgaatgaacccggaaggcaggaggttgcagtgagctgagattgcaccattgcactccagcctgggcaaaaagagcgaaactccatctcaaaaaaaaaaaaaaaagaaagaaaaacaaatattagccgaacatcgtggcacgtgcctgtaatcccagctactcaggaagctgaggtaggagaatcgcttgacctcacgaggtggaggttgcagtcagccaagattgtgccactgcactccaacctgggtgacagagcaaggctctgtgtcaacaaaaaaaaaaaaaaaaaagaaaaagagaaaagaaacatgcttatggctgaagagctgagcccaagtctatgtgattctgaataacatgcttttaatttaattaattaattaatttacttatttatttatttgagacagggtctcactctgtctcccaggctgcagtgccattgcaccatcatggcttggctcactgcagccttgacctcctgggctcaagtgatcctcccacctcagcctcccaactacctgggactacaggcacacactgccatgctcaactaatttttttttttgtttttttgcattttttgaggagacggggtcttactatgttgcctaggctggtcttggactcctgcattcaattgaccctcctgccgcgacctcccaaagtactgggattataggctttagccactgtgcccagcctaaaacttttgagaaagaatgcttcttgttgattgtctcccctctctattaccttagtgtctggcatatagtaggtgcttgaaagcacttgtttagtgcctaagccaggggctgacaaccttactgtaaaggcccagatagtggattatttgaggctttgggggccatgtgctctcttgcaaccatgcaaccctgccgttgtagtgcaaaagcagccacagacaatactttatttataaactctgaaattggaatttcatataattgtcatgtaatgacgtattattccttttgtctttttcccactaactatttaaaatgtaagaactagctgggcgcagtggctcatgcctgtaatcccagtactttgggaggccgaggtgggcggatgacctgaggtcaggagttcgagaccagcctggacaacatggtaaagccctgtctctactaaaaatacaaaaattagctgggtgtggtggcaggtgcctgtaattccagctactcaggaggctgaggcagtagaatcgcttgaacctggcaggcagatgttgcagtgagctgagatggtgccactgcactccagcctgggcgacagagcgagactccatctcaaaataataataataataataataataataatataaaatgtaagaaccattctttcttagctttcaggccataggaaaacaggcagctcggatttggccttcaggctgtattttgcagattcctggtctaaataattaccttaattatcacagtagcagatactagcagatactaagaactagtgtatctccaaagtctagtttggtgcccggtacaaacattctttccccaaggtggagtccacttgaccagagtggagagttacagtgctggggaagagttggaagacatcgctgcctgggggtgggggaagggcagagaaatctcttggggtttgttctggggaaactgggaattgtgggagaactgaggaggcgggaaaggggactttaagaatattattgtgggccaggcgtggtggctcacgcctgtaatcccagcactttggaggctgaggcgggcagatcacgaggtcagtagatcgagaccatcctggctaacacagtgaaaccccgtctctactaaaaatacaaaaaagtagccggccatggtggcggatgcctgtagtcccagctactcgggaggctgaggcaggagaatggcgtgaacctgggaggcggagcttgcagtgagctgaggtcgcaccactgcactccagcccgggcgacagcgagactctgtctcaaaaaaaaaaaaaagagtattattgcaggttaggaattggaccttttattacagaggttctcactggggactgaattgtcccatgtgtgtgtgtttgtgtgtgtgtgtgtgtttgtgtgtgtgtgtgtgtgtctgtgtgtgtgtgtgtgtttgtgtgtgtgtgtttgtgtgtgtgtgtgtttgtgtgtgtgtgtgtgtgtgtgtttgtgtgtgtgtgttttaaatctgcagagagcttttggttgccctaatgatagggatgggggagtcattacggtgtggggtagttttttgaatatatatatgtgtagatcccaaattcatatgggttagaagaaccatgattatcagagtctataaccttgttctatttttttttttttttttgaaacagagtctcactctgtcacccaggctggagtgcagtggtgccatctcggctcactgcaacctctgcctccccggttccagcgattctcctgcctcagcctcccgagtagctgggactacaggcgggtactaccacgtccagctaatttttgtatttttagtagagacggagtttcaccctgttggccaggatggtcttgctctcttgatcttgtgatcggcccacctcggcctcccaaagtgctaggattacaggtgtgagccaccacgcccggtccaaccttcttctattttatctgcctattctattttatatgtttacatgttctattttacatgtaagtgttgaatgaacactgatgtttccaagaatgtagcagctatggtgtaaatcaagagaagatttgactctgtttggtatgggaatttatcaagaaagagccactcttttgaagaacatggcactctcagtaaagccgatgcgacaacacaccacgctgtctgcgtttgtgactgtcactggttattctacacacacgtgtgtgagcacttgactgcttcgctccgtctttcctggtggaaacccaaatcatttctctatatattatttcattagaaatcctcatcatttcatttctcctttttattataattagggcacaattgtgattggttagaagagtagatgggttataggatcagcacattttttttttttcagggtagaaaagagagcttttcagctgggcatggtggctcacgcctataatcccagcactttgggaggctgaggctggtggatcatttgaggtcaggagttcgagaccagcctggccaacatggtgaaaccctgtctctaccaaaaatacaaaaaaaacaatgtaccgggcatggtggcacgcatctgtaatcccagctactcgggaggctgaggcacgagaatcgcttgaactcaggaggtggaggttgcaatgagccaagatcccaccactgccctccagcctggactatagagtgagaccctgtctcaaaaaaaaaagagggcttttcaattggttggttaaaacatgggacattggatctgatggcaccaagaatgcctgccctgtaacactgtttgagctgatgtgtggggaactgcttttggattacttatgggttgctgaaatatacttctttgaatgcagagattgggcccctgattatatttgggaggcaaaaccatcaccttgtaggcacctggcagggtaaaataaatggatgcttcttagaggccaactgctctctcacttcctgtttccgttttgtttgcagcgtaaagccagatgccttttatctcttgtatcagtgctggttgtctgagaatttttttttttttttttggacagagtctcgctctgtcacccaggctggagtgcagtggcgcagtcttggctcaccgcaacctctgcctcttgggttcaagtgattctcctgcctcagcctcccaagtagctgggattacaggtgtccaccaccatgttcagctaatttttgtgtttttagtagagatgggatttcaccatgttggcctggctggtctcaaactcccgacctcaggtgattcacctgtcttggcctcccaaagagctgggattacaggtgtgcaccaccacacccagctaatttttgtatttttagtagagatgaggtttcaccatgttgtccaggctggtcttgaactcctgatctcaaatgatctgcctgcctcagcttcccaaagtgctgagattacaggcatgagccaccatgcctggcctgggcagagtttttaaaaatgcttcaaactctcctttagctcagtttcggtagagtcattcctttacagtatagttacagtggagctgccaatcagctcaggccacacccagcccacagtctcagaggggctgggtccctgctctttctctctccctgaaaagtggctgttaattttctcctttagtctcctttccccagaaagatatttccctttaccttatgggagtttgataaaactggcatctccagccttcttttccttatgttggtttttctgccacaaaaggcccagagacattgtctatggaacgtttggctgcagctgggcaggtgttttattctattggaaaattccactaggattttctatgattacaatagagcatgggtcctcagtcaaaccctccaccacttataagaagctctgtgactttggggaagtgacttaacctctctgagcctcactttttctatttggaaagagtgatgggttggtaggttttatgtgttaactcttagggatacagggtgcacagctatttgcctaaacatcattttgggtgtgttcgtgagggcgttttgggatgactgtcatttaaattggcagattgagggaagcagttgcccctcctaatgtgggtggacttcatccaatccacggaagacctgaatagagcaaaagtcggtcctttccgaagtaagagagaattcctcctgcctgaaggtttttaaactgcaccattggcttttttctgcctttgtactcagactgaaacactgctctttccgggtttcgagcctgctggccttaggactggaactaacaccatcagttctctggggtctccagtttgctgcctcgccctgcagatgacagcacttgttagcctccataattgcgtgaaatctctttctctgtttagacattggttctgtttctctggaaaaccccagtcaatacaggcggtgatcatattttgaggattaaatgatacaatgaatagaatatgcttaacacacagtgagtgcttggcacatatgatctcctcaatacacatcagctttatcatggaaattattatgtatcattatacaaaatataataagatttcaaacttgtgttctcttacatgtcctctaaattattcaatggaacaaaaaactcttcactcatttttgtgtgtatgcaaacttaatgtctttcaataaattttccaagttattgtatgttcgcaaggacataattctgtttgacttcccatctttccaatactagtagtgagcctcattagcacatgaatgctggtgtctgtgagatgtgcttgccttcactgtcctgtttgccttgcccaaggtgggcgatggaaaggacaagccatctattattggttggaggaaggaccaaccatctactgtggcagtctgctcaggctgccatacaaaataccacatactacgtggcttaaacaggagacatttattgttcactattctgggggctgggaattcgaagatcaaggtgctgggtgatttgtttctccagtgagggccctctttgtggctttcagttggaagccttcttgttgtatcctcacaggggagagagagagcacgcaagcatgagagagtgcaagagagagagggagagatcaagcaagagtgagagacagagaaagacatctctggtgtctcttctaatatggacacatcacatctccaggaccttaggcttatgatctcatctaaacataatcaccaaagccgcatcttcaaatacccaaataccgtaacactggtaattagggtgtcagcttcgacatatcagtttgggggtggaggcacaaacgttcatttcatagcacttccttttccaaaaatgctccttaatccctccctgccatccttgctattctcatttgacagatgaggaaattaagactccacgatgtgccttaggttgcccatagctgtacatcttataagtgcgagctccccagataattgcattcatccacaagagcagagttaaccacagcatcatagccatccagggagcataatgccccgttaaaaataacaaagcgtagagacccagcctgaactgaagatgtgtctgtggttggggttcagggttctttgatttccagatctaccacccagatatttgtcaagttacatctacctctggtgctcatttccatatctctaaaacagaaataataactgagaggattttgtggcgtcatgcagatgaagtggctctcaagagcctgacttagtaaacgttggctgcgtgttgggcattattagctaagatgtataaacagcagaggtttggtttgtatgagtagatcatattcctgcctgttgtcactgagggagagcagagtcctaaggggaggggacacaggtcaggagaattctagggggtgggggatgtttctgatttctcaacaatgggtaaatctgggaatctcatgagagcttcagtgggtaaatcttggaatctcgtgagcaaaatgtggacgtgaagaaggaagaaaagctgcttggaggattggtgaaggaggagggaaagggaaaaataaaaggaaaaaaacatttaggtggtgctaagtgccacacattttccgtttttgcatcagtgaattgtaaaatcacactgcaaggctggggatattatccccattttacagatgagagagaggaggctgggcaagttaatgaactggttcaaagtatcacagctagagagttggagccaaagtgagatcgcacagctacgcagactctaaagcccttgtctgtatattgaatcaaatttcccctttttctggcttaggtaaactgaggcaggaagtgatgagaaagggttaagagacgtcggctgctccttaaacatctcccttcccagtgtcatttgccatccataaactctttcaaaatgtgataatggttttgattttcctgtcatctcgatttgatatgagaaatttgggatttccaaattgacagaaaactcgattttaaagatgctggaaggcaaacatctgtgaaaaatcacaggaataatgtcaacatctgtccctgtgaaaggaaattgctgaggttctcaatttacagccaatcaatcaatcttggaggccagggtgcttgcaaattgaaatgcatgttgaagctatagggatggctaattaatttagtttgtatgcctataagatttttcattgtttccagttaaaaaaaaattctcttttgaatagaaaacgtgtgcatatggtaaaaaaaaaaaaaaaattaaacagtaccagaaaaagtatacagtgaaaattaagtttgttttccatcccaaccaccagttcttcttctccaaggtcacaagtgttgctggcttctcttgaaagtttccagagatacaatctttatatagaaaaacatatgtatatatgtctcctcccggttttataaatgatagcccattgtacatattacactgcatcttgacttcattcaacaatatatctttgaggtttttgcatagcagtccatatagacattccttattctttttatcagctgtgtagtattccagtatacggatgtgtataaattaatcagttccctcatggtggacattcaggatattttctgtcattctccacaatttatgctagtatgtccatcttggtgtgtgttcatcagtaggatacaaatctagaggtgagcctcctgggcagatgggatgtgcatttaaagtatgatgccttcatgtaaagggaaggttttcttttcttttttcttattttattaagagacgggggtctcacgatgttgcccaggctggtcttgaactcctgggctctagcaatcctcctgcctcagccttccaaaatgctgggattacagacgtgggccaccgtgcctggccaggttttctttgttatcttggagggagcatcacccccgtcaaggagatcagattggtgaaggtgggatgctgtgtctgagagcttaatgactgttcacagatattgtggctgcccttctctaatgtacctgcttcttcaggcccaaaaggtggaaatgatgtttgtttcttacttctttggggctttgactgtgccattgagattttgtgctcagggataaactaccgtgtatttacagttacctcaacctgtgaggtttgatgcctctttctttctttctttctttctttctttctttctttctttctttctttctttctttctttctttctttttctttctgtctctttctttctttctttctttctttctttctttctttctttctttctttcttccttccttcctttctttctttcttctttcttttttccttcttctttctctttctttcctctttctctctctctttccctccctcccttccttccttcctccatccctcccttcctttcttgctttttttttttcttgctttgttacccaggctggagtgcagtggcatgatcatagctcactgcagccttgaacttctgggctcaagcaatcttcctgccttggccaccctgggattacaggtgtgaaccgtggcgcccagccttggccactttctttattctaaacttctttgttccatactttgcttcttttccctggatccatccccaccagcctcccttgtcactccagtgataggacactcagtcttgccaagtcaatgtaaacccagacccttctcatttaaaacctagtctctttggtaaacagtcaattcaggattctcacatcaatctgagttttaaatcttaattagttgaaagattttcatatctttatctttccactttggtcactggcttcgctgtgggtgctgcaccactcagacctctgtgcaggaccaccgaggccctctgtccccccagctgctgggagacctggctgctaacagctcatagcaaagtcctgcctctggcaagaaggcacctgtaggaagccacctagtgctgggaaatcctcctcccctcctaggcatcccataatcctggagggttacaaaggctctgtcccttgcccctctgtatgggagtgtattagtcagcgttctctagagggacagaactaatagtatagatgtatataaaaagcagagtttattaaggagtattgactcacacgatcaccaggtgaggtctcacaataggccatctccaagctgaggagcaaggaagccagtccaaatcccaaagcctcaaaagtagggacgctaacagtgcagccttcagtctgtggtcaaaggtccaagagtcccaaagctgaagaactcagagtccgacgttcgagggcaggaagcatccagcacgagagaaagatgaaggctggaagactcagccagtcaagcccttccatgctgctctgcctgcttatattctagctatgctggcagctgattagatggtgcccacccagattgagggtgggtctgcttttcctagtccactgactcaaatattaatcttttttggcaacaccctcacagacacatccagaaacaatactttgtatccttcaatccaattaagttgacactcagtattaaccatcacagggggtgtctcaggggtcctggcgactgttccacagtgccactcccctctctgcccaatgctgcttccttgctttccagcaggtgctcctcccagtaaaccccctgcacccagatctccatcccacagcttgtctctctagaaacctgacctatgacaggcttataaacaccacaacagggcatgggtatgggccaggagagctactcctctcatctgctgagggtcctaccccaggacccctggggagggatgaggtccctgttgttcatctgggtgatcatctaactcctgatgagcccaggagttagagaccggcctgggcaacgaagtgagaccccatctctccaaaaaaaaaaaaaaaagtcaaaaaattagccagatgtggtgcatgcccccagctacttgggaggctgagatgggaggatagcattagcccgggaggttgaggctgcagtgagctatgattgcaccactgctcttcatcctgggtggcagactgagaccctgtctcaaaaaagttgtcatggtcctatgacatttttttaggtcctatgcaggggtgcaggtggaggtggtttctggttctacctgactgtcttcgttcagcctggtccatttgttgactctgctacccagaagtgaaagaatatggcatctttctcatctctatatggtccccatgcagtaaggagttgactcagccggtctggggagttcaaatcctgcacattccaaagaaagctctggccgttgattggctcctgggagataaccgccaagtctttggaacattctgcctgataagagtgtctttgtttacctatggcctcaggctgagctagctagtccatgctaacaatgcaatttatggtgagtgcctgtttttgtatgtgtcagtttgacctctagaggggctggagactgagtaacaaaagtcacccatgcaggtgctccatgcctgggtgatgaaatgctgataaaacccctggacaccaaggcttgggggagctgctgtggctggcagtactttgtatacattgctaattgtctcttatagcttggctgtgtccccacccaaatctcatcttgaattgtagcccccacaattcctacgtgttgtgagagggacccagtgggaagtaattgaatcacaggagtggtttcccccatactgttttcatggcagtgaataagtctcacaagatctgatggttttataaggagaacccctttcacttggctctcattctctctttgccagccgccatgtaagacatccctttgctctcccttgctcttctgccatgattgtgaggcctccctagacacgtggaactgcgagtccattaaacctctttttttttttcataaattacccagtctcgggtgtgtctttatcagcagcatgaaaacagactaatacagagcattaggagctatccttctaactccactgggagaaaactactggaaacttacccctggtctctcttggagagacctatgcatcttgtaccttggttgattttaatctgtatccttttagtgcaataaacaatgttcatggggacaatggctttcctgattctgtgggtccttctggcaaatcaatgggcctgagggtggtcttggagatccctgacaaaagtcactgtagccagggaccatcttctgttgagcttatttcagaggaagatgtcataggtaacgggcgttgggggcaccctggttccatttgttgactctgctacccagaagtgaaagaatgtcgcatctttctcatctctgtatggtcccctgcagtaaagagttgactcaggaggtctggggagttcaaatcctgcacattcctaagaaaggtctggcccttcactggctcctggaagataaccactaagtctttgcagcattgtgcctgataagggtgtctttatttgcctttgttctagttcttgttctaggtgctggtgatagaactgtgaaccaaaggtcattgccttcaaggagtttatattcaagtggagaagatggaaaaccctcccctcacaaacaaacagactctgaaacctgataaataaatattagcattcagtgaagtgttaatgagtttctgtgagcacatacaatccttagcagagtttatctcatcctgcctgagctagcccctgcctccctccccagcccacatattttgccacacccttttcattcctcccaacattccaattccttcaacacatggaactccttctcaccccagggcctttgcacatgttactatctctgtataaatgcattcctctcacttgacacctggataactcctcattgtcctagtcttagcttaaatgtcatcatctggccaggcctgatggctgacacctgtaatcccagcactttgggaggcggaggtgggaggttcgcttgagcccaggagttacagaccagcctgggcaatgaagtgagaccccatctctaccaaaagaaaaaaaaaatcaaaaaattagctgcatgtggtgctgcatgcctgtagtcccagctacttaggatgttgaggtgggaggatcatgtgagcctggaaggtcgaggctgcagtgaactgtaattgcaccattgcacctcatcctgggtgacagagtgagactgtctcaaaaaaaaaaaaaattcatgaccttggggaagcccagttggatactctcctctttccccagaccagctggatctaccatcataggctgttatagcatgcatccaattctctctctctttctctcgctccttttttttttttttttttgtagagatgcagtctcactatattgccagggctggtcttgaattcctgggctcaagcaatcctcccacctcggcctcctaaagtgctgggattacaggtgtgagccaccatgcctggcctgttacctttcatttttatttcagtcatcattctgagtggctgagcatatggatgtgttgattgttgaaataaatcatttaggcaaattgttacgggccccatctaaattcagaatccagccatggatctggtctgtaattcttcccagccacactcttccctgttggagtccgagttctccactctagacctgcagcgggaagctttccagggaccagccagttccaccgcctccagagccacccctcacctgctgacctcttcctatgttagctgcccctctcgctgcctgctgcccttccccgggccagctgatacgagagctggcgataacttgaaatgctccccgcagaagataaatgagaggggaatctcagcaggcattgagctctgtacctaacgactggcagttggggcttctaattttaggcctgggaaggaagctgatttctgtgatgaaggtggccacacgctttatcaagggccaatttagcaaaaatctaaaatgtatatgaagccgtggtaagtctggattttcttggtatttatgctgggaggttacttaatgagcgtttgctgtgtgaccacattgcggtattaatcataggtggcattataattctctaaaataacagccataaggcatcagggcaattgaggcttgtattaagggaatggtccttttttttcttgctgaagttaggcagcatgaggctggtgtgtttttccttaaggcaccaaggcatctgaggttttgcactgggaatccctgggctctctgggccctctgggtccctagggtcttctacttgccaacacagccttgggttctctgcttcctgttggggtgacaggaacacattggtggtctctgatggatataccaggcgctctgcataatttttcttcttgcttccgggggtaactccagccccatcccttgaaggtgaattttatgttatatatatatttttttgcttaggcaagtttgatttgggttatattttcatcataaagaatcatgactattgcaaatcattatatagaaaagtgattttattcttgagcctgagatattcacagtgaaaatgacaacacattatttctgagacacctgctgggggcatccaccactttcccccaacccattctctctattcacctccaaccaattttatccaaaagccagctcagctgactgtacaaccacaagggatttggagttagatggatatggcatttatcagctgaatgatcttgggcataatactcaaaccttctgtgcctctgttttctcatctttaaacggggatagcacagggttggtgtgaggaataaatgagttattattgtcatagtaatatactaacatatagttaaatataattctatctgtcagatgtagacaggggtggagaatgccttggaagtcatttcttcctacagaataagtgatatggttttgctgtgtccccacccaaatctcatcttgaattctagctcccataattcccatgtgtcatgggagggacccagtgggagataattgaatcatgggggcagttcccccatactgttctcatggtagtaaataagtctgataagagctgatggttttataaggggtttccccttctgcttggctctcattctctcttgcctgctgccatgtaagatgtgccttttgtcttccgctatgactgtaaggcttccccagccatgtggaactgtgaatccattaaacctatttttccttataaattactcagtctggggtgtgggggtatgtctttatcagcgtgtgaaaatggtaccataaggaagtaccttaaggttagacaataagtacaataaggaaggaggaccgcaatccagtcttgtctcccagagccttggcacagaaagatggtaaccaatgctttgtcttggaaaatccctcctacctgctggggagacaaaggagcaaatccagcagaagatggaggggaagtgctggttgagttgcttggcaccccttgccttttttcaccctcttcctcagctccctgatcaccatactctccctgtgtcttttggctcctgagatcagttgttgatgaaatgctgggctgcgctcactcccagagtgggaggaaatggatgtgggaaccctcttggggagatgggcagttaccggggcccagagaaccaatgagggctttatcctgcagtcagagttcaacaccagcccttcccagaatcaatcacaccctcctttccactatttcactgtctgccgtgaactaacagacattggttgtgttgccctcagattcataggctgaagtctaacccccaatgtgatggtatcaggaggtgaggcctttggaaagtaatgagatcatgagggtggagccctcatgaataggattagtgcccttgtaagaagagatatgagagagatgatacccgtctctccaccacatgaggacacagtgagaaggcagccatctgcaagccaggagagagtcctcaccagaccctgaccatgccagcaccctgatctcagacttcccagcctccagaactgtgagaaataaattgctgttgtttaagcttcacagtctattataatttgttatagcagctcaagctaactaagacactaccctgacactctatttcagaaatgacaaggtttgggctgggtgtggtggctcattcctgtaatcccagcactttgggaggccaaggtgggtggatcacctgaggccaggagttcaagaccagcctggccaacatggtgaaaccctgtctttactaaaaatataaaaattagcaaggtgtggtggtgcacacctgtaatcccagtactctggaggttgaggcaggagaatcacttgaaccttggagacggaagttgcagtgagccgagatcataccacttgtactccagcctgggtgacagagtgagactgtctcaaaaaaaaaaaaaaaaaaaaaaagatgagatttgacttcacaaactaaaacttttgttcagagagaagaggaaaagggagggtgggggaaaccacccatgctcccaaagatatgagacgtagaattgatctaagtgccacaaagcagaatttttctgactccattctgtttctcctgtgataattcagctgctttcaaattcctctcctctcagacggtcctgagaatccagtgggagttttctctgtgctccagaacatagtggcctcttgcattcattccctaccagaaataatgtctcattcaccagctattttctcagccaataatttttgtccacccccattcctccttcagaaacttgcccttcccagagccctaggagacccagaaccccataggattcttttggctctggccatggctgtgtaccaaggggttggatatgggattacagccaggccatgtggactctctcccagaaatttggagttgaaaatctctgagcttatctctggaaggtgcttgaaactagagggggatagaaagttggtgacaatatagtcatgtttggcctgtggacaattgcaatagaaaaaactgatatgcagggtgatatggtttggctgtgtccccacctaaatctcaaattgtagctcccataatttccacatgtcatcggagggacatggtgggaggtaattgaatcgtggggcgggtttttcccatgctgttctcgtgatagtgaataggtctcacgagatctgatggctttaaaaaggggagttcccctgcacacactctcttgcctgccaccatgtaagacatgactttgctcctcattcgtcttctgccataattgtgagatctccaaagccatgtggaactgggagtccgtgaccactctttttctttataaattactcagtcttgggtatgtctttattagcattgtgaaaacagactaatacatgggggggcggagagagagagagggagagagggagatggggagcgagaagatgggggagagagagtgagagagagagacagagagaaagaaagaagagattgagaacacaatacagacttaggaaggacagaccgggagctcccagaaagacagagacaggctgtgttgactcctgctatctttctatcccaaaaccctgctgtgctttctgactttggttttgtgggatgctttatttaataggttgaactgtgttctccaaagagatatgttgaaagccctaacatctcagtaccccagaatgtgacctctgttggaaacagggtcattgcagatgtaattacgaagatgtgatactggagtagggtgggcccttaatctaatacgagattgtccttagaagaagtaggaaatttggacacagacccacagggaagacccccttgtgacaatggggatagcgattgaagttccattttaatgtacgtgctgccgaagcgagcacaaggtagagattgaagtgaagctgctacaagcccaggaatgcctatggttaccagaagccaggaaaggaaaggatgggatcttccccagaggctcggggtacagctttgtgaaccccttgattttggacttcttccctcaagaattgtgagagaataaatttctcttgtttcaagccacctcgtttgtgctgttttgttaatcatccttaggaaatcaatatgccccttatccttcttgaatgagctctgtaccttataatgagattattgcagtctaaaaatctagaactagttgcaggaacatcacagacaagggaaagtttgaaccacaccatggatgagtgacaagcttggaaaagaagggcacttcacctctgtggtattctttgcaaaaactcatgacctgagtctaatcatgaaaaaagaaaaaaatcagacaaactcaaatggaggctaatacggtttggctctgtgttccaaatctcatcttgtggctcccataattcccacgtgttgtgggagggacctggtgggagatgattgaatcatggggacaggtttttcccgtgctgttctcgtgatagtgaattagtcttatgagatctgatggtttttaaaaatgggaatttccctgcacaagctctttttgcctgctgccatccacatcagatgtgacttgctcctccttgccttccaccatatttgtgaggcctccacagccacgtggaactgtaagtccaataaacctgttcttttgtaaattgcccagtctcaggtatgtctttatcagcagcatgaaaatggactaatacagagatatatcctgcaaaatccgtccccagtactcctgaaaactgccaagctctgtagagttagagttagaataccttttgttgttgaagatgtgagggaagtatgcatgtgaattgactgctgaattcactttttttttttttgagacggagtctcgctctgtcgcccaggctggagtgcagtggcgggatctcggcgcactgcaagctccgcctccccggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctgaattcacttttgtgccatttttgtaaatacaatagttttgtacaaccttagaaaaataaggaaaggctgaagaagctacacatttggttggtgtggtttctaatgtagttttattttacattaaaaggtttagacaatgggtcctcatggcagttgctggtgacttaccttgtagttgtaaagctgggttcttgttttctttttcttttaaatgaaattataataataataataataataataataattattattattattattattattattttgagacagcctcttgttctgttacccgggctggagtgcagtggtaagtcgtagctcactgcagcctttaactcctagattcaagggatcatcccatctcagcctgccaagtagctgggaccacaggcagatgccttcacgcctggctaatttttaaattgttggtagagatgaggtttctgtatgttgcccaggctggtctctaactcctgtgctcaatcgatcctcctgcctcagcctcccaaattgctgggatgataggtgtgagccactgcacctggctgaggccttgttttcttgctggctgtcagctggggacctctatcagcttctagaggccacctgcattctttgacatggccctgtcacaacatggtagcttacttcctcctagccagcaagggagtccctaagtctcctaaggggaaatcttatttggtgaaatatgatcaagggagtgacatttggcacctttgccatattctgttgattagaagcaggtcacaagttccatcctctctcaggcggggaggcttgtacaagggagtcaccttagctgtgtgcaatcaggaatacagcccaggggccgtgcctgacagttaagaggactcagtgtgatcaagctgatcaatatgaagtgggttaggcagctgccagtgctaaattctgtttgggagttttccaagaaccagccctacccatgagtatctctctgggtaaacctcctgcaacttgggagtcaccttagctgtgagaaccgtttttcgatcttaccagcaaaaatgacagcccagggtattccaggcagctgcttctccagctccaggcagatgattttggccctgccttgcaacagaaatggaatcgtttcgaggggatggtctcctcgctctggatccagcagcagcagatgctccagccgaagacgtgtgtccactctgagcaaggttgagagaatcaaattaatttcttttatgacccgaggcaagcttgaaattggctcttccaagatgaaaaaggagaggcaggagtggcttgcctggctccctactctccttctcctcctgcctccacctccttcccagcagggctccagcaatttaatcggggtgggattccttccaccaagcaaggcagtctgtcacgcgccgctgcagtaggggccatgccagagacagcttttcgaagcggcatctgtgggcagacatttgggcaaccccactaggctggcaagccctggtcgatttttagtgacctcttagaagtagatgggagggactgtcagccatgccggaagtgggagagagcagaaggggtcaaagacaagcctcggctgggaagagcatctctgtggtcctgtaattgatgattggggtggggagcattgaaacgtttcccttgaatcacagccttcagtgagaatggctttgcctgctgtttggacggtgtgttgagagtagggtaaccatatgtcctcatttgctgcaacagtccctgttacgactgctttcctggttttgcctgtctcgaaagcattctggtttgggcgataacttataaggtcatcctaattctgggtttcacagtctcagcactgtggacattttgggctagataatcctttgggtgagggttgtcctgtgcactgtaaggtgtgtagcagcatccctaggctctgcccactagatgccagtagcacaaccccctgccccattgtcattgccaaatgtcccctgaggggaggaggaggaatcacccctggatgagaaccatggcccttttttaagggcactgttgaatccttccttctgataccatctgggggtaacttgagtacttggttcatgttctggaaggaaaaactccacatagtgcttctgggttcatttagcccatgtaagcttcgtttttctgtttcttagaccagtatctcactttttgcagggagaggtgggacctctcctccattctcagcccatgtgttttgggtgactcgagagactgggtttggcagatgggagaatgccattctcctggctgttgtgattgattcagaaacctgcctttaaggtggttcaaagagcatcagtggcaggacttctgttaggtggatagggaaagaggggttctctttttgctggggttgcaaacctggtagggtggaaaccgggagctgctggtggtcatctcatcaccctgggggagagcctgcctgagaaggaaatcacaggagagccgagctgagagaggagaaggaaagccgatcacactgtctaacagcctgtatcccctccaacctgatgacagatctcacctagagtgaatttctcagtgaagccagtttgacttgagtttctgtcaacttgcaactcaaaaaggccatgtgttgccatgaggtatttctctgttccctttcctaatctagagattaggtaactttaattctgctaatgctgagttttgtctcatcaaatggaaacatcacagaagtctctgatcttgccccatcaacccttcccattacctctagggctcagccaatgctgctggtatcttttgcttcattttttcttttcttttcttttgtttctttctttcttttttttttttctgaggcagggacttgctctgtcacccaggctgaagtgcagtggtgtgatcacggcttactgcagcctcaacctcctgggctcaagtgatcctcccacctcagcctcctgagcataggtgcacaccaccatgcctggctagttttttaaattttgtttgtagagaggggagtcttactcaatcattcaggctggtctcaaactcctgggctccagcaatcctcccaccttgatctcccgaagtgttaggattacaggtgtgagccactgcatctggctgcctcatttttcttaatctttcaagactctgtagaaataatacctactccttttcattcctccttatctcctgtcttcctttccaacactatagccctcttttcattattacccacatttacaaaaggtctttgtaacttaatggcatacccagacagaaataatgttctctgggttaattatctagtttgccacaatctcctgtaccagattctacccagcctgctctgattataaaggggactattgagaaatagctgcaaaaatgcacaaaaccataagaattcccattctaagacccagagcagatggcttttggattattcccttctctttttctatcatatgtttacataattgagttcatcatctatatgaagtcttacatacatatatttttataaagatataaaattatacaatcaccccaattaaaaggcatgaacattattttaataattggaagaagatttcattgtacgaacatagtgtaatttcagaaacatttttctgttggttgacacttcattttttaccatttgcaataatgtgatggcttccttgggcatacatctttgtcctcaactggatgtactcccctaaaataaatttctaggagtggaccttctgggtcaaaatgggtgagtatttgtaaggctcttgatacatattgccaaatgaccttccagaaaaattgtgcctgtttacatgcctaccagtggcatggaagggtcagatgtcagaatcatgattgcaattattgataaagatccagctagttccagttttgccaacaatattaacaccaccagcacatccaccaataataataataacaataatggtatgataaataaaataggtgatatggtttggctgtgtgtctccacccaaatctcatcttgaattataatcaccaggtgtcgcgtcgagggagggagctgtaagccccacgtgtcgaaggagggatgtgattggctcatgggggtggcttctcccatgctggtctcatgatagtgagtgagttctcatgagatctgatggttttaaatgtggcagttttttcccgtgctctcacttctccctcctatcgccttgtgaagatgtctgcttctccttctgtcatgattgtaagtttcctgaggcctccccagccatgcagacctgttgtgagtcaattaaaccccttttctttatcaattacccattcttggccagttgtttatagcagtgtgaggatggactaatacaatagacttattgggagcttgtaatattctagctatgttactaaaaatttcacacattatttcatttagtccatccagtaacctagagattaggtattattataattcccccatttacaaaataggataataaggtacaaagacgttaagcatcttgcctaatgaccacagccagtaaatggtggatcttagatttgatgccaggcatctgacttcttcaagcattgtttactgttttagtatgacggagatgactagttggatgtaattccacctgaatggctagctttactgtgtacagatcaccaaagatctaccttgaggaaaaacattgctatacattgcaaataatagtcagggctctggtattaatgtttcccagtctctccctcctaaggacattgtcaccctcccagacaggtgtgtggtagaaggaaacgactctctcctgatgctatgaattccaaagaattcccattaaccatatttctaagccagtttgctttctttcaatgtgcactttctgcaaaatgccatctgcacttgtttcctggggaaaccatctctctgaggtgggtaagttctcattgtgaagatggggacttgcctaatgtttggcattccctttttggggcacgtacagtgatttctgaactgacttgaaaggccattaacttggtttttactgccttttctggcttgcaaatttaatgcctggctcccaacatgtgtgaatggacaaacagcatcagcatcatctgggaacttgctagaaataaaaattctcaggctttaccctagacttacagaaccagcaactctgagggtaggttccagaagtctgtgagtttacaaatcttccaggtgattctgatccgtgctaaagttggatctactgctctaaaccttagtttcttcctttataaaataatagtagtagtagctgtagcagtaataataatattggcttcatggttatagggggaattccatgagtaatttgagtccttggcactgtgcttggcatacagtaggtgcttaataagtggtagttggcatcactatctctgaactgtgaaggtcgctgtgcttaacctatgtagtatttatcagccccgcatcccactccgttcagggatggcccttctcctgcctgtgggtctggtgggaccactctgcagaatttcttatgcccagatcttctatcatggtgtgacaaaagcatggcccatcaaatgcctgccttctgggaatttgcatcttaaggagagatcatcaaggatgtagagtgattagagtccggtcattccacgaccctgcagcctagtgcttctcaacctttaatctgcttaacgctaactggaggatcttgttcgagggcagattctgactcgaaaggtctggggtggttctgagagagagtctgcatttctgacgagctctactggagatggtgatgccagtactgctggtttctggactcacggtgcagttgcatcccgagagtagtgaatctcatttttcaacctcaccttagaatcacctaggggaggtgtgaaacaagacagacctgagccagttaaatctcagtttctttcctttttgccttgccttgctctgccttgccctgccttgccctgccagggtctcactctgtcatctaggctggagtgcagtggtacaatctcggctcactgcaatctccacctcctgggctcaagctatccttttgcctcagtctcctgagtagctgggactacaggcatgcgccaccacatccagctaatttttgtatttttagtagagacgaggtttcgccatgtttcccaggctggtcttgaactcccgggctcaagtgatctgcctgccttggcctcccacagtgttggaattacaggcataagccaccatgcccggcttaaatctcaatttctgagggtgagggcccagcatcagtggtttctaaaagtctctttggttgactgttggctgcagtgagggttgagatccaccaccatacaaagatggtccaactggaaccccctcaagtctgggaactctattctttctctgatcctgtaagctccccgctttttaatgtaaagatttggttctgttggctgggcatggtggctcacgcctgtaatcccagcactttgggaggccaaggtgggcagatcacgaggtcaggagtttgagaccagcctggccaatatggtgaaactccgtctctactaaaaatacaaaaattagctgggcatggtggcgtgtgcctgtactcccagctactcaggaggctgagggagaagaatcgcttgaacccaagaggcagagcttgcagtgagccgagatcgtgcactacactccagcctgggcgacagagtgagactttgtctcaaaaaaaaaaaaaaaaaaaaaagatttggttctgttgcttgaaaactaagaaccttaactgatagagcctcagaaatgagaagagagtcaaggtgagtgttcattgcctctgggctctccagctgcagatcctcttgcttctctgtgcttctctttgggatgacaccacagagacattaaaccttttggagggcccgtacagtaatttctgaaccaacttgaaaagccataaacttggtttttcctgccttttctggcttgcaaatttaatgcctggctcccaacatgtgtgaatggacaaataaaagaggaactgtcccttcctctctttgcccccatcaagggccacctgagagactgtatctctttaggatcgcttagctctttcctcagtcccaggtctggattttgcgggtgacagcttcaccagtatgtgacaagccatgccaggtgaccagagtgtgaaccagcctgctcacctgtcaggtggtggtaatgaaaaccgatggacctggtgcggtggctcaacacctgtaatcctaacactttgggagtctgaggtgggaggatcacgaggtcaggagttcaagaccagcctggccaatgtggtgagggcctgaagtagtgggaacagagggtgactgaggcagagtcagccttaaaagatcagtcgctaaaaaggacttcaactgcctgcctttggggagagggatttgatgggagaagggctggggtaagacagctttgttttccatttcaagtcatttgtatcatttgcttgtactgctttgataaagagaaatctgaaattctagaaaaaattagaagtgaaaaaaaattcctttatagccatgagcagaaccgttaacaatagcagccgggtatggtggctcacgcctgtaatctcagcactttgggaggccgaggtgggtggatcacctgaggtcaggagttcaaggccagcctggccaacatggcaaaaccccgtctctactaaaaatacaaaaattgccaggcgtggtggtgggtgcctgtaatgccagctactcaggagactgagtatggagaaacacttgaatccaggaggcggaggttgcagtgagccgagagcgctccattgtactccagcctgggtgacaggagtgaaactctatctctaaacaaacaaacaaaaagcaatagcaatagcaacagtaatgacactaacttatattgatgtgctagattttatccatgtcacctcattcacctttagttctcactacaaccttgggtgacaaacttgtgttggctttagcactttactggatttgacactgagcgttccctatacctggaaccacttcggtcctagataaaccaaagaggatggctggtcaccctactacagccccagaggcagctgctattaaccaatgcatgctgcaggggaggaaactgagaccctgagaacttctgtaactcgcatcatggtcacacagctagttagtggtagaaacaagttacataccgactcggtggtggacacaattaagggtcccacagtcagttagttgtagaaacagttaagagtcacacagctagtcagtggttgacatagttaagggttgtgcagctagtcagtggtagatactgttagttaagggtcacataggtagtcagtggtggacacagttaagggtcacacagttagtgatagatttaagggttacacagctagttagtggtagatacagttagttaagggttacacagctagttagtggtagacacagttaagggtcacacagctagtcaatggtagacagttaaaagacacatggatagtttaagacacatggatagtttagtggtagatacagttagttaagggccacacatctagtcagaggcaggtatatttagttaaaggtcacaaagctagtcagtggtaggtacagctagttaagggtcacaaagctagtcagtggtaggtacagttagttaggggttacacagctagtcagtggcagacagttaagggtcacaagactagtcaatggtagacaattaaaagacacatggatagtttagtggttgatacagttagtgaagggtcacacggctagtcagtggtaggtacagttagttaagggtcacacggctagtcagtggtaggtgtagttagttaagggtcacaccgctagtcagtggtaggtatagttagttaagggtcacacggctagtcagtggtaggtacagttagttaagggtcacacagctagtcagtggtaggtacagttggtgagccatctcatcactcgtttagtagtagagcttggattggaaccaggtagggctgtgtctgttacattacatcacgtcacatggagtctcagagctgaaaggactttagggtcgccgtgtctattccccttgtttgtagatggggaaacttgcctgagtggcggaacgccctacccaaggtcgcatggtgagttttgggcttctaagagaccactggaggaagtcagggagacatgccctggcagggacccgtccggaggcctgccaattggctttgagaggagcgcgtcttgcatctcccaggaaggattggcagagggagggcgggcgtctcgggccgggggctggtgcccggggctggggctgaggggagggggaggctgcttctctttgtaatttacatacacagcagcaacagcctgggggaaaacaacccaaacaaactctcaaaggatgttttggacttaatcccgggatcggaagcagctcggtaagataaataagataaagttggtgtgcctcttaaggttgaacgatcatatcactattgcatttgaaatattcatgaggggaagggaggtatgagaaacagctacagaaacatattctgctttgaaaaggcagaattcaaaggcatgaaaaatgaatcaggggaaattaatgtcgaggttgggaggggggtgggctggtggggggacaattattgcccagaaggaataaggaaagagatgtggaggagatgtttcagactgggccgtgatcagaattctgtatcctgcctggaatatttgaaatgtcaattgtctcatatatcatttgaagtcaatacttggtcgcaaaatggatgattctagcaaggattaaaaagcagggtgggctgggggatatgggatggggagggtggagtggggtggggcagggagatggaaaaagatgggtaaagtgaactaagtcctataaattgtggacgaattactgatcactcaaagagggctctggaggagtaagatgcaaagaaacgggaatttcttgtgatttcttgcaagtctctcggtcttggtttctccctttataaagccaggaggttgggctggatgttctcctagatggtcccactttgccttgtggagggggtggggctctgatttggagatgtgcttggaaatagagggttccttaaggcaagagggtcaagggtattgacgaacggtagcaatacagacatgatgcttgtggttaatggtggctctcagcagagccctgcaagtctacaccgtgttaggggggccagtggggtttggccccatttaaaagcaagcccttggactgtggactggcgcggtcattctagagagatctgacactaaagcaaatgaaggctgcatattctctgtggtcccagaccagcagcatcagcatcacctgggagcttgttagaaatggaaattctcgagtctccttccagacttcttgagtcaaaatctgccttttaacaagatccctgggtgagtcctgtgcatattaaagactgagcagcagcaattcccctcctggatttataccccagagaaagtttcacccaaggatgttcaaggaggtgggtttgtggtagcggggtattggaagccactgctgtgcgcatcagaaggggatagataagcaaagcatgacagatactcactgtgggatatgactgtggtagttagaaaaacaggtctgatcttcacatgccagtatggacggatcttttattttatttatttatttatttatttatttattttgagatggagtctcactctgttgcccaggctggggtgcaatggtgcaatcttggctcactgcaacctccgcctcctgggttccagcaattctgcctcagcctcccgagtagctgggattacaggcgcccgccaccatacctggctaatgttgtatttttagtagagacagggtttcaccatactagccaggctggtctcgaactcctgaccacaggtgatcctcccaccgcagcctcccaaagtgctgggattacatgcgtgagccactgtgcctggcctggatggatcttaaaaacaaagcacaaggggaaaaaaagtgagcaatagaatcaatttatagcaagtgtctttgtttgtgctgctataaaggaacacctgaggctggataatttacaaagaaaaaaagtttatttggctcatcattctgcaagaatcatggcaccaacatctgcttctgatgagggcttcaggaagcttccactcatggcagaagtgaagaggaactggtgtgtgtagatcacatggtaagatagagagagaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaagagagagagagagggagataagaggggtatgaggaaggaggatgagagaaggaagaaggagacagggaagaataggagacagaggagggttccaggttatttttaactatcagttctcggccggatgcagtggcttatgcctgtaatcccagcactttgggaggccgaagtgggtggatcacttgaggtcaggagttcgagaccagcctggccaacatgtcgaaaccctctctgtactaaaaatacaaacattagccaggcatggtggctcttgcctgtaactccagctacttgggaggctaaggtgggagaattacttgaacccaggaggtggaggttgcaatgagccgagatcttgccattgcactccagcctggccgacagagcgagactgtgtcccaaaataaataaataaataaataaataaataaataaataaataaataaatagaaaaaaataaaaacacaaaaattagctggatgtagtggcgggtgcctgtaatcccagctacctgggaggctgaggcaggagaatctcttgaatccgggaggcagaggttgcagtgagctgaaatcgtgccactgcactccagtctgggcaacagagtgagattacatcttgaaacacacacacacacgcacacacaatcagttcttgcaggaactaagagtgggaaatcactcactcttgagagaatggcacccagccattcctgagggatctgcccccacgaccaaaacacctcccaccaggccccacctccaacactggggatcacatttcaacatgagacttggcaggggccaaaacaaaccatatctagaccatagtatgacacaatttttattggttaaaaatgtatttgtacacaagacagtatgcttaaagctacaagagggcagggatttctgtctattttgttcaccgttgtcttcttgccacattctgaacactcaatatttgatgagcaaatgcacttcacaagaatgcgcacacattcaagagaagaggaatacctcagctgagggggttttgcactgcaccgtggtgatgccagaaactcaggagtaattcactccactttctgcacctggggtgaaatagaagcccaatcttgtgtgagaggtgagggggagggtggccgggctggcctacgtttgcagagcttgttccatttcacagtggcttggctgccctgcccttggtccctccaaggtcctgcttgctcagctcttggcttgccaccttcctgctccatctctaaggctttattggctgttcctgtagaaacagactctccaagtcatggctttttctcagcattttgcatgtaccacctcccttatcctcacaacactgcctacaacactggttctcaactggggacacttccatccccataagggacatttggcaatgtctggagacatttttgattgtcacaactagggtatactgtgctactgtcatccagtacgtagaggccatggatgctgctaaacatcctacaaggcacagggctgtccccagactccccagtaaagaacgatcaggtccaaaatgtcagtggtgttgaggctgacctagggtagggggctctaatatctctattttatatgtgaggaaacggaagcatggtgaggttgggtaatcctgtgtgaggtcctgcagctggtaggcaatggagatggggtatagaccaagtgagtctggctctagagtccttgcttttaaccaccatacatgattgcttctcagaagtggaaaacgctgagacaggcacagctttttatacctttactcacttatgttacggcgagggtgaccagctgtcttggtttgcccaggcctgagcggattcccagagtgtgggacttgcagtgctcaagccaggatggatagtcaccctagtaacctccagactctgtagacatctgtgtttgtgatctgattgttactttcagtctgttgagttcatattactgatgtaagagttaagaagagattatttaggcagatagtgagggtaaggaagtcctcagtaaggttttccttttaatgaaaagcagtccccaaatcatttttcttttctaacggagagcatcctgtaaaatcaagctgcagacataggcaagcaagctggaagcttgcacgggtgaatgccggcagctccgcccataagaaaaggctagctggggctaggcacgtccaacagggcagctccatcttcccttctctttgccagccatgtgtacagtaaggagcaggcaacaaggagccagccaggcaaagaccccatttgcataataacactagggtggggcggccaacttccccatgcgctatgtaaatgtcacacctggtgcaaccaatctttgggccctagtaaatcaggcaccgcctccccaaccctgtaaaatctggtgcactctgacttgggccagaagtcccactgggtgcccccctctcggaagagagacagtgttctcctttctcattcttttgcctattaaacctctgcttttaaactcactctttgtgtgtgtctgtgtccttaatgtttttggtatgaggcaacgaatctcaggtattacccccgagagaatgatgctgcttcactctgtgctaatcacaattgacacaagggccgaatcccagtctcaagttcacctacgatgactttatcatccacatggctcaaagctgtggtcaagtttcctcctgttttgaaaatatgtgctatgctccagttaagtcagcacagctctaggtagatcaaaattcatctttggaggatttctgaaattcacttgaggagtagatcagttggggatggtgtgatggaggaaaaagaaaatcccaaggtttgatggcaaggttagagtgaccttctgaccttgagcaaatggcttaagctgtctgggccttgatgtcctcgtttataaaatgagtccgtaataaaagccacaatgatgagcatcaggcactgtgctgagtgtttgccatctaaggggttatctggttatctcatttaatcatcacaaccacgggaggggaagctcctggggttaagtgtctcgcccaaggttgcagctggtggggaatagtctggttgcaaacccagagaccacacttttaactgctatggaatgttgtctcccgtggctgtttctgaggagatagaaaaacatgccaattagggccaaaaaaacgggaggtggcctcaagggcagtgcattacattaagagtgtttgcaaaggcgtgggtgtttctccacccccgagtcgctgctgacttcccgacacctacacgcagggtcaccctgcagcttctgagcacctggccggctccccccagcaatgtgtgtttgatgttatcagggggtttgaggcacggctgaggccccaggaatctttctctttcatggagaagccaagctcacatctcccagtggcagctggtgctggcgtctggctggagttgcagggactatgtgtcagctctagcagttcctgcgactgtattcacctactgaaggtccttgatctattgctggggtttgccaagggtctcaggggtctgctgcggagcagagagactgattattattttttaaatctccagttgacccccttgttctcacgttaatcactttgagaataaaaatggctaccaataattgagcacttactacgtgccaggcacaggcacatcctatgcctccctccctcctcctccggggctgctggctctccttatcctttttatttttgcttttttctccacagctagtaactgtgttctaaacaccaataagagggcctggcaaatgtggttactcaataacatttattgaatgaatgggtgtgagcgagtgtgtgttaggctccctgctaagcccattacgtgtattattttactcaactctcacagtaatcctatgagataagcttcatctttatctccatgttacaaaggagaaaatgtgctcagagatgtcaagtaatttcccccaaaatgcacagcttgtgtcaacgcaagaatgcaaatttagcagtctccaaattctaccccatttactatctcccaaatagatatgtataaatatcccacatatggagatacattttaaggatttatacgtatctatttccatgtaacacggccacacatatgtatcctatataatatgcacatgtatagtatgtgcacatattcacgtgtaaatgtatcagttacctgtagctgtgtaacaagtaacaccaccctcatggttataaaaataaacacttattttttgctcataggtctgtggtttagctggagagattctgctttaggctgtgggttgagttcaagtctgattcttacatttatttctgaggtccagattggagaagcagtggtacctggtgaaggttggcagcttccagagaggagtgagcagaaatactcaatgccttttaaggcctaagctgggaactggtgcaccgtcagctctgctcatgttccattggccaaaacaaacccatcactaacagggcagaggattctgttcttcccatggtgaagggaatgagagggaagtaaatatttgttaaacaggaaaacataccactatcatattttaattatatatggatgtatttgtattttatctttttttttgagatggagtttcgcacttgtcacccaggctggagtgcaatggcacgttcacggctcactgcaacctctacctcctgggttcaagcaattctcctgcctcagcctcccgagtagctgggattacaggcacctgccaccatacccagcttttttttttttttttttttttttgtatttttttttttactagagatgaggtttcaccatgttggccaggctggtcttgaactcctgacctcaggtgatccacctgcctctgcctcccaaagtgctgggattacaggcataagcctcggcgcccagcctatatttatctttttcacccatgaccccagcttcagtgaggagttctgttactttgtacttttactgggcattcgtttccttgtttggaaaatagtgactataattaataaaagtgtttgtattcttgcaaattgctaagagagtaaatttgaagcatccccaccacttgttaattagcttgatttcaccagtccgcaatgtatacatatttcaaaacatcaggttgtacacaataattatagacaatttttgtttgtcaattcaaaaagtaataagtaaaggaaaagaaaaatgtaagatactttaaaaaatgactggctcgtgttgagaagtaacttttactatttatttgtttttttgtttgttggttggttggttttttttttttttttttgagacggagtttcgctcttgttgcccaggctggagtgcagtggcacgatcttggcttactgcaatttctgtctcccggggttcaagcaattctcctgtctcagcctcctgagtagctggcattacagatgcccaccaccatacctggctaattttttgtatttttagtagagacagggttttgccactttggccagactggtctcagactcctggcctcaggtgatccacctgccttggcctcccaaagtgctgggattacaggcatgagccaccgtgcccagcctaacttgtactatttatttgagttaagccaacacacacttgagttccccacatgtcatagagtgatgtggacaagcccttgaaatctggctttcctgattacctggttgaccttgtagatgcctctctgagcctcagatatgttctctgtgaaatgggcatgaaaccagtacccactttgtagagcactgtgaggattaagtgagaggatacgtgcaaaagtttaccacagtgcctggctccagaagccactcaatatatatttgctgttgttattaatattgatactattcttacaacaaaaacagcacagatgttctaatgatcaattatcctagcctgtcgtctgctggtccccagcccatgtttctcggaccctgtctgtgtgtgatttatgatccgactctctctacactttgtgttggggtttgatttttcctgctttggctcaagacccccttcctacagaaatgtttggacccatcttacagacttgtgcctccttggctgtcctgcctggtcagccccttggaacacagggttggccctaagttggtcctcccatcccagcaaaatggttcactggggcattgcaggttgattgtggaatttcaacaatagcatgggtggtgggaaaaccttcggacatccacagacagcagcctggatgtataagagatgggggtggtgttctttccatctggagtcctccgggagctgtcaagcctggaatctttgcaatttaggcagtctgtttgtaatggtctcaagaaaacccattctgcctacaaacgcggtgacctttaatttttttttctcagatttttccaagatgcacattgactcttcctgtcaacgtggaaggctctaatgccgcctggggcatttagattgcatttgccaatcgctgactgctgtagccaatttgttcctgatctcaaggtcgattttgaataactttagctgggctaagtctcttgcattgaataactgggaaacaacctattaaggtagcaggcgggcgggggcaggagggggcagggggctgtttctattttgtagaagttctttgattttggataaatgagaaggcttctagctctgccagtcatggactatgtggccttgaacaagggagggaaagaaagaaacacatgccaagtacctagcatatgctagacacagtgctgggcacttcacacatgccagctgcttaatctactccgcgaggtgaacatcgtgatctccatgttacagataaagaaacggagtcccggcaacttgcagggttgagcttggatctgtctaaagccccgcccctccccctttttttgtttgtttgagacggagtcttgctatgttgcccaggctggtgtgcaacagtgcaatgatcttggctcactgcaacctccgcctgccaggttcaagcaattctcctgcctcagcctcccgagcagcttgggattacaggcacgtgccaccatgcccagctaattttttatattttttgtatagacgaggtttcaccatgctggccaggttggtctccaactcctgacctcttgagccgcccgcctcggcctcccaaagtgctgggattacaggcgtgagccaccgcgcccggccgatgatgctctttttaaactatccttatgagtgtatttcagcaacctcccccgacccgaattacagtaccacaggctgcgtcctaatgctgtgccctctcctgatatggtctggctgtatccccatccaaactcaccttgaattgtaataatccccacgtgtcaagggcggggccaggtggagataattaaaacatgggggcagtttccgcatacggttctcatggtagtgagtaagtctcacgagatctgatggttttataaatgggagttccgctgcgcaagctctcttgcctgcccctgtgtagcatgtgacttcgctgttctttggccttccaccatgattgtgagacctcctcagccatgtggaactgtgagtccattcaacctctttcctttgtaaattactcagtctcgggtaggtctttattagcagcgtgagaacaaataaacctcctgtcatcttctctccttggattcactcctctagtctgagatgtctggttcgccttgtttccccagcggtgggctcatgccggcaggggttggcatcagcaactgttctttgatcccatgactctgattttgagatgagcctggtgcagcttggtggtttcacgtggggccctttggaaggagaaaacctggtccgaatccctgcaagttgtgtgacgggttgggttccttggaagcccgagaatgagatttgggtaggtgcggtttattcaaggtgggggttctcaggagaaggaaagtgagggaaggaggatgatgggggaggggacagagccaagcaagaatgggctctcaggctgaggctagccttgatctcacgtgggtctctggagtgtattctgccttgaagcaggaggactggacttttgtgtgactcctctcgcctcatatcgcttagtcattggccagttcagcatgtgagagcataactccctgggtgaaatggcttttgctagctaaggaattctccggagaaagtattggtataagccattaggcacagatcagcaaaggctgaatgatgagtggtttactggcaatgaggatctgggtgaagcaccaggaacagctgcgacgttgtgcaactgctctgcctcagttttcctcatctgtaaaatggggatgttgataaaacccatctctgagcgttgatgcaagggttagatgagatacttgcatttgtgttactgataatgtgcctgtcactggccaggtgcaaagcaagggctcaacgaaagcataagctattattattattattattattgttattactggcagttttggatccatagcaacaagcacatataaacaatgctcacttcttctctagtttaattcttataactcttctgagataagttctacttctaccctgttttacagacatggaaactgaggcacagtgaggtgaagcactttgagctcacatgatggggctgagattccaatttagggagtccagtcccagagcccccaagtgagtgctggtttgggactgtctcttctgatcatgacaaatcttttttttgagatcactctcagttccttgaatgtatccatcttctctgttgtttctgggtctttgtatattctattctctgtgctggcaacagcttttccgctttaacctgatctgccctggttcatcccttgagactgagctctgagctcatatttggccttttttttttttttttgagacaaggtctcaccctgtcacccaggctggagtgcagtggtgcaatcgtgactcactgcagcctcaacctcccaggctcaagtgatcctcccacctcagcctcccgagtagctgggactacaattgcatgctaccatgcccagctaacttgtgtactttttgtagagatgaggtttcgtcatattacccaggctggcctcgaactctcaggatcaagtgatctgcctgcctcaacctcccaaagtgctgggattacaggtatgagccacggcgcttggcccatgtttggccttttccaggaagccctccaggttgcctccttccacagccccttgtctgttccccaaagtgtctgttaggatgtattacacttgcctagtcacttgtctgcctctcccattagtctatggctccaaagaattgaatattttgcctgtctctatcattgtcacccctgcaagtagcatttgtctggcacatagtaggtactcaataaatgtttattttgtggctgaatgagcattccagattcagaactggaaacattggaggcttacaaaagttcagaaccgcatacattggaggcttacaaaagttcctgttgagttgaattaattcattttgaaatgacatggactaagttctttctgggaaggtttcctaactaaatccgtgggcatggtggactggagcgttccagaaccagtgcaaagagtcccctgtccataggcatgagatgaaggctcagggacttaaaatacacttctattgtggaaagttcttcagagacccttctggcattttatttaattgatgctcggctcatttattttattattttatttttattttttaatttttttattttttttttgagacggagtcttgctctgtcactcaggctggagtgcagtggcgcaatctcggctcactgcaacctctgcctcccaggttcaagcaattctctgcctcagcctcccgagtagctgggattataggcaagtgccaccatgcccagctaatttttgtatttttagtagagacggggtttcaccatcttggccaggctggtcttgaactcctgacctcgtgatctgcctgcctcgacctgccaaagtgctggaattacaggcgtgagccacggcgcccagccatttttattttattttttttgagatggaatgtcactctgtcacctaggctggagtacagtggcgcaatctcggctcactgcagcccccacctccccggttcaaacgattctcctgcctcagcctcccaaatagctggaactacaggcacacacccacacaccaccacacctggctaatttttgtatttttggtagagacggggtttcaccatgttgcccaggctagttttgaactcctgacctcaggtgatctgcccaccttggcctctcgaagtgctgggattacaggcatgagccaccacgcctggcccagttaatttattttatgtaatgaatgtatttcttttcattaggaaagtatgagaatcacgttgctgaaaatgtgggaaacctagaaaagtagagaaacccacccactatcatttggtagtaaatttcttcagatttttctcctcccatatatgtttttctctttctttattaaacatacttatgaccatactattaatatagtttagtatcctgctactttttttccgtttagcaaaatgagatttttccaggtttaattacatagttttaaaaataaccatcatcattttgttcttatttttttcccttttgaatttaaaaaaaaaaatcatagtaatatgagcacatcgtacaaagttaaagtacagaggagctgctaatgaaagcagcggttcctggccccttctctcctctctcccctccttaagtcttatttcccggaggtaagtgcttgaaatgttgtttccatttttaggtcttcggttatttatctctgtaactccaaataagatgcttatgtggctgtttcttgatttatcaatttaagacattttctattgactctgtgccatagaagatgaggattcagcttattgacatggttcctccccactttttgtccttccccagtttttatttgaaaaaagtcagacgtgcacatggcaaatgatgaccggaggatgaaggagcctctcttactctaatgcttcagtcttccacccacccctcctcccagtttcttgtgtatctgtggcaggtcaaagatgagtgcaaactgtttgataccccatgcattcagaaatggggtctatttcccttttcctgagcctgggctggcctgtgactgctttgacgaatagattgccatagaagtgacaccatgatggttctggtcctggcatttaagggatcatgcagtttccgccttacacctcttggaactcttggttttaaacccctgagccactgtgtgagaaatctgagggcttttgctggagggaaacctggagagactctgagatgacatggaaagggagagaagttgctctgagcccagcttccatcctgtcccactgatatgatttggctgtgtccccatccaaatctcatcttgaattctcacatgttgtgagagggacccggtgggaggtaattgaatcatgggggtgggtctttctcatgctattctcatgatagtaagtctcatgagatctgatggttttataacagggagtttccctgcacaagctctctttttgcctgctgccatccatgtaagacgtgacttgctcctccttgccttccaccatgattgcgaggctccccagccatgtggaactctgagtccattaaacctctttcctgtaaaaatgacccagtctcaggtatgtctttattaagagcatgaaaatggactaatacacccaccaaggtgcctggcacatcactaaaactgcactagacccttcagagcagccccgaagccctctgaatactactgagtgacctcagatgatactgtgtgagcagaagaactgcccagctgggtcctgcttgaattcctgaccctcaaaatcatgatctataataaaaacagttgtggctttaagccataatgtttggggattaacttgaatggcatccttcaggagataccccatgtgtcataggttttggggatggaggttatcttagcctaccaacagtgcctgatacaaatatgtgaatgtttcattgggtcacgcaatctcaagaaagcagggataagggaaagagagaaagaggaagagcaaaaccaaagaagtgcatattgcctagtggagttgcagtttcccagaaacacaagcatgggataactctggagtcagtcatctgccagctcctgctgtttcctgtctcttattggtcaaagcttgctccactctgcacttctgagtaatggccctcagcccctcctagcagcttctgggggatccaggacctctgggagctgataggtgtgatagaggccagcccttaaccccacccagggtaggctgagtcacttttattttattgtaaaattgatatttatttacttattattttaaggtaattttttttgagacaggatcgtgctctgttgcccaggctggagtacagtggcacagtcatagctcactgcaacctcaaactactgggctcatgtgatcctcctgcctcagcctcctgagtagctgggactacaggtatgcaccaccatgcatggctagtttttaaaaagtttttttggagggatggggttttgctttgtttcccaggctagtctcaaactcttgacctcaagagatcctcctgcttcagcctctcaaattgctgagattacaggcataagccactatgcctggcctctattattattattttgagacagagtctcactctgttgcccaggctggagtacatcggtgcagtcttggctcactgcaacctctgcctcctgggttcaaacaattcttgtgcctcagcctccgagtagctgggactacaggtgtgtgccatcatgactggctaatttttgtgtttttagtagagatggggtttcgccatgttggccaggttggtcttgaactcctgacctcaagtatccacctgcctcggcctcccgaagtgctaggataacaggtgtcggtcacagctcctggccactggcttctatttttttattttttgagagggagtctagctcttgttgcccaggctggggttcagtggcgcaatctcggctcactgcaacctctcaagttcaagagattctccagcctcagcctcccgagtagctgggattacaggcacgcgccgccacgcccagctaatttttgtattttcagtagagacaggtttcaccatgttggcaggatggtctcgatctcctgacctcatgatccacccaccttggcctcccaaagtgctgggattacaggcgtgggccatggcacctggcccagcctctatttttaaagtaacttttatgggatgtcagacattgtaaattttaccttggtgggtgctggatgtttttgtgcctggcacagtcctaggtgctgaggacctagcattgaacaaaaacaaagatccctgctcttgctgaacttccatgctactgtggggagacaatcagtgaacaacaagcataatttaggtttgctcttattatactgttgcacacgtaccttttgtatatgtactcttaaacggccattgtttttagtgatttgattgaacaaatatatttgattgaacagatatatccttgctgaatgagccatttctctattgatgggtaattatattactttctctagtaagagtcatcagaagcttagaggcttaagaatctaagctcaacaaacagaggttggagaggttattataaagtccattgtgagagcagccactcctaaccttgggaccaaagattggtattgcgtgacctgtgagccagaattaccctggattggactgtcctaccaggtgggcccctggccagcaaaagagatgatgggggttgttagaatgtcagagagggccttagacaccccttttccatatagtctccagctctttgactaaaacctgtaccccagtatataatcagtcacccaggcctagagtcaaggtcttttatatcatgtaaatttattttttatttttaaaattttttatttccatagggttttggggaacaggtggtatttggttatgtgagtaagttctttaatagtgatttgtgagattttggtgcagccattatctgagcagtacacactgaacccaatttgtagtcttttatccctcaccccctcccaccctttcccccgagtccccagagtccattgtatcattcttatgcctttgcatcctcatagcttagctcccacttgtgagtgagaacatacgacgtttggttttccattcctgagttacttcacctagaataataatctccagttccatccaggttgctgtgaatgccattaattcattccttattatggctgagtagtataaatatactgctggtatatggcatatatataccacagtttctttatccactcgttgattgataggcatttgagctggtttcatatttttgcagttgtgaattgtgctgctataaacatgcatgtgcaagtatctttctcatataatgatttcttttcctcagggtagatacccagtagtgggattgccagatcaaatggtggtgctacttttctttaaggaatctccacactgtcttccaaggtggttgtactagtttacattcccgccagcagtgtagaagtgttcccttttcaccacctccatgccaacatctattatgttttgattttttgattctggtcattcttgcaggagtaaggcggtatcgcattgtggttttgatttgcgtttccctgatcattagtgatgttgagcattttttcacatgtttgttggccatttgtttatcttcttttgaaaattgtctattcatgtggatttataccttccccgtattcccatgcctttgtcttcaatgggactattattttttgtctaatggctttgaattaaatcttctgtcttctattccactgatctccagtctccagcaataattatgctgtttgcattggggaaggtggcagatgtagttgttgccttgcctatgtcctctggcataggaactcaccattcctactgcaagcatctgcaatactgcctggggctttgtctcactgccataacctaggctcttgtggggcaggctggaagtgcagagaaaccaacacaggcacatctcccccagccagctgctgagggcagttgccctgccttccataccttagggtgaggcaggcgctatgctgtctcccagatgtccccagtgggattgaaccccagttgcccatagtagcagcctgcttataaacatgacctggattagctcctttcccttctctgtctcatttccctattgtcatcccagtgtttcctgggctcactttccaaatcaacccacttatcttcaagtccttctgtattagtctgttctcatgctgctaataaagacatgcctgagactgggtcatttataaaggaaagaggtttaatggactcacagttctgcatggctggaaaggcctcacaatcatggtggaagacaagaaggagcaaagccacatcttacacggcagcaggcaagaggcttgtgcaggggaactcccatttataaaaccatcagatctcatgagacttactatcaggagaacagtatgggggaaaccacccccatgattcaattatctccacctgcccccgcccttgacacatggagattgttacaattcaaggtgagatctgggtagggacgcagccaaaccatctcaccttctcttaggatttgtttctggggaaacctaacctatctaagatgatgaaaaatacaaagaaccaggaaaatccataaatagatttaacaagaaaattttacctagtcttgatgagtggcaaagcttgactgccctgaggaagtgactttgctgagctgagacctgaggatgggtaggagttagctaagcaaagcagcactggaagaacagcaggggaagaacattccaagcatagggaagagcatgtgcgaaggtcctggggcaggaatgctagtgtggatggggtgcagaaagagaggcagagaatggtggttatctttggaggatatatggcctgaaagtgaatttgggtccctgactttaagtctctttcctctgcagtttaattatgtctatacacttttttttgaaccccattatggtctggcttcatttaaatgcatctgaaatgaaatctctaatgttaacagtgttgtcagatgtgaaggcttcatttctctttggttctttttcaccgaatgctatctgtgagtttctggggaggatatgaggattttgattgttttgatttttttttttttttgtatgaccacattatgttaatttccccattgtcttagagtatgagaacataaaagcaataactcatttatatgaagactgaatgtgctgagaggttgtcatggaaacctctcatgttggcttgagtaaattgaataacccctgttaaaagactgaacacagataactggcaggctttgtttcagggcaagagttcacaaactggggtccacagatgctcaaacattctatcatgaatagaattcggggatcccatgatcttggacagttaaaaatacatcttatattcttttatctctacctgaagtttagtctttctttccattgtgaatgaataaagcaataaacaaacaaaaaaacaaaagattgaacacagaacttatttacccaattgcatggcattcacaagagatgagaaattcaacatgatacatgagatttttcccccccgcaggggcagggaggaggatgaagagggtgaatgaatgctaggaatgtattatttttatttagacagtgatttctatttttctttcaaagattatatttttgtttccaaatgggagaggtgttatggggcgatagagaaaggatccagggaaaattgcatggtaaaattgctcctgggaaagaccagcttagggtatccatgattgtcgcttctgtagccctgagcatgtttctccccttggagcatcctctgaagtcttggtcagagtcgttgaagagacatgaaccttttcagcattttctgctttgctttggcaggattgtttactgcctatcaagctgacttacaaaaaatactagttctgttgtttttcatttttaaaagcaaattgcttcacctcttcgtaaataactccttaaaagaaaagccgtggatgacagatgaggaagcatagttgggaacagagcgcggcactcgctcacgatcatagtgtcaggtcacaggaagccctctgagccccgggggtgggggcagcctctttaaagtgattatggagcaagaggagcttgaacagtggcactctgagcgttgtcttgggccagcttggagatcaggtcctgggctccagaagacatcgaggctggttctacctggatgttgcatccgtaggtatcaaagtaggagatgctttcgaggggtgagtttttcatcagtggcctccaccccaaagcaccatagtcctacctccttgttgtatgtctttcttctcacaggctgcttgtcagacttcagaatttcatgggcatgatgggcaaataagcttgattaatgcttcatgcttgctatccactaaatgtgttcccaccatgtgttgaaacctaatccccagtgtgatggatggtattagggggtggggcctttgggaggtgattaggacatgatggtggggactccacaagtgggattcatgcctatttatttatttatttgagacaagagtctcaccctgttcccaggctagagtgcagtagtaccatctaggctcactgcaacctctgcctctgggtttaagtgattctcctgcctcatcctctgagtagctgagactactggataattatctaccacacctggataattttttttttttttgtatttttagagagatgaggttccaccacgttggccaggctgtcttgaactcctgatccaagtgatctgcccatcttggcctcccaaagtgctaggtttacaggcgtgagccactgcgcctggccaatgcccttttaaaaggggtcccagagagcccctttgcccttccatgatgggaagacacagtgaaaagagggctgtctatgaactaggaagaaggccttccccagacactgaatctgcctgggacttcccagatcttctggagagaaccgtgagaaataaatgtctgctgtttgtaagccacacaacctatggcattctcttatagcagtctaaatagactaagataataccataaggatctacctttgggactgtgtgctgttataataaaggctctgataagtcctgctagcgccgtttagaccaggggtttctaaactttttgaccacacaagttatttttccctttgcaagcaccttccatggaaatcttttgggaggctgaggcatgagaattgcttgaacccatgaagtgaaggttgcagtgaactgagatcatgccactgcactccagcctgggtgatggagtgagactctgtgtcaaaaaaaaaaaaaaaaaaaaagaaaagaaagaaaaaagaaaatattttcaaaatgatgccatggattaaatctgatagtcacaaaggatccttgtctggtgttacctccatttgatgggtgaggaaacaggagtcctgagaaaccaagtaacttgctcagggtcatgctgttaggatgtagcagaatcagaaccaaaaccctaagtcccagacgactaaaatccaccactccaatggagaggcccttactgcaatgacctgttctgaaggagcgaaacaaggcatttattgcagcatcatttaattaggaaaaaaatctggaaagaccctgaatgtccaactaaagggaaatagttgatatttatgatacttccatacaatagaatgttatggggcatcgataatagacatgaagcacagtaacatgaggtggcacatattataatgtaaaatggagaaataaagcaaaatgataatcatgcaaattaaatgcatgaaactaaaaaagaaatacaaaatagtagctgtctctagatggtaggtgagtcagttcaggtcctctgagtagcagaaggcaaaacagaattaattgtacaaggtcccagtctccactgatttcaaatccacttttcaacttctgtatgaagttctcattctcttactaatttttttttttttttgaggcggagtctcactctgttgccaggcttgagtgtagtggcgcgatctcggctcaccgtaacctgcgcctcccgggttcaagtgatttcctgcctcagcctcccaggtagctgggattacaggcgcatgccaccatgtccagctaatttttgtatttttagtagagacggggtttcaccatgttagccaggatggtctcaatctcttgatcttgtgatccacccacctcggcctcccaaagtgctgggattacaggcatgagccactgtgcccggccctcttactaattttaaataacatgtctcctgcagcttctgtattgcaaatataggaagtgattttggcgagcatttgaattatggtagctgatctgatctgttgtgtctccttactttctaattctttctttactttctgctcttttcctccctctgcttatttgcttcctcttgctgtcttcctttatctccttttcttttcctacaaatttctaaaatgatagctgatgagaaggaagatcactcttacataatttgattcctcagtttccattttcttctttttacaagtataacattctatatttcttttttttaaaaaaattattttttaattgaaaaataatggtacctattgatggagtacgtagtgatgttttgatatatataatgtatagtgatttgatcagggtaattagcatatccatcatctcaaacgtttctcatttctttgtgatggtaacattcagtatcttccttctagctatttgaaactgcattattattaccattatcattttattttatttagacagaatcttgctctgtcacccagactgatttgtagtagcatgatctctgctcaatgcaacctctgcctctcaggttcaagcgattcttctgcctcagcctgccgagtagctgggattacacgcatgctccaccacgcccgactaatatttttttagtagagatggggtttcaccatgtttgccaggctggtttcgaactcctgacctcaagtggtctgctcacttcagagtcccaaagtgctgggatcacaggcacgagccactgcgcctggccaaaactacatattgttaactgtagtcatcctacagtggtttacaacatgaaagaaaaccaagtattaattgtgcaggaaattcattgaagaaaatgcctgtgaagggaaatggggagggagcagggagagatttcagaccgtaatgcaggtctgacacctctgaaagcagagtgggaaggaagagagatagttagaaagagaaaggcttcggcacaactctgagaatgtatcagccagtgtaatagttcctaaggcaactctctctgttggacaactcccagttgggttagaatcacctaattccgttacttccactgtgcccagtcactggctgggaaaatccccagggaagtgcagcctagcatgaacacctcggtgggtcaaaaggtacagcagctagaggttgtcagttagctctgcttccagagcagttcaccttgaaggaagatttgagcacagaacttccatgactgagagcttctggtgcactttacagcagaggaatttgtgaagcaggttcactgttcactggctaccaacttgtccagtgagacagaacactcccacacaacaagttacctgaggtaggtttattacttacagataggcagcaagagatggtagaagcctaggattcattgtgagctattcctccaagtccccggaaacctgctgagggtaagtagagtcatatctgtgcatgccttacttgcacagaagctcagataccccagaaagcagctggttctgtgttttataccccaggatgtgtgatttgctgggctaaagtgtttaagacattttgtttctaggggtggactgaaacagaggttgggtcgttctggccagtccctctctatctcaagatgttgcatttctagcacattcttcagttattcttaagaaccatgagttgggaaaagagggaagaactgggtaggcccaaggccacccagtgaactgtctagcagcattttgcattttgtaaaagcacattaacaatggttttgagaagctgaagtctgtggactgattctccctgtaaatacaggcctgctttactagcacctgcactttctggttcttatgccccctcaaaagtgtactgagtcatttgaacagaaggagactgcccctccagctccccacaatgggaaattgtcatcactgccacaaaatgaatagaaggacttggccaagttcatcttcctttgtttactgcctgcacttcatcccatttggaagagagaagcaatagcattgaatggtctggcttttttttttttttttttgtaatcatggctatacagcagggtaatgaaggtcagagatgggggcttgaaccacctgcctgtggttttgaggtttccccaaatactctatggttgttaagttccataagaaagggacttgtttttcatttttattttctttccaacttttattttaggtttgggggatacgtgcgcagatttgtttcatgggtaaattgcatgttatggggcttggtgtccagattatttcatcacccaggtaatgaatgtagtacctggtaagtagtttttcaatcctcaccctcctcccatcctctaccttcaagtaggacccagtgtctattgttcccttctttgtgttcatgtgaagtcagtgtttacctcctaagtgagaatgtgcaatatttggttttcttttcctgtgttaatttgcttaagataatggcatccagctccatccatgttgctgcaaaggtcatgatttcattcttttttatggctgcatagtatattccatggtgtatatgtaccatactttctttatctagtctgcaattgatgggcatctaggttgattccctgtctttgctattgtaaatagtgctgcaatgaacatatgtgtgcatgcatctttaaggtagaatgattattcttttgggatttatacccatgaatgggattgctggattcaaccttagttctattttaagttacttgagaaatctccaaactgctttccagtgactggactaatatacattcccatcaacagtgtataagcgttaaagggacttaactgctgaatagtcttcacccaactcaaagcctggctctcagtagatactcaatatattgcttatacaattaaaggaatggttaaaaggaaggaagatgtatgcagaatctgtgtactgctaagtcagcaaacatttgctgagggtctgttgaatttggtcctgctcaacattgaacttgcccacttctcaccaccattaaggctccagaaaatttgtttatccacagccttcttcgtctaccttattaccttgtcatttctttgagacctaatatccattcctcctgatctccagctcaactccctagaatccatagcttctagagttttgtttatttattccatttttatttatttgatttattccactttcattgaatatcaagacctccaggcatagttccaggcacctggtatgcagcaacaaatatgatgttcagataatctcttgctgcataaaaaagagcctgatcccacagtggctggaaacaaatatttggtattattgctcatgactctgtgttgattgggctcacctacgtggttctcatttcaagtcctatgcagttgtagtcagataatgactggggctggagtcatctgaaggcttgactaggctggccatccaagatggctgagacacatggctggcatgatattggctactggttaggagctcagttggtgctgtcgcctggagcactttcatgtggcctttctatgtggtttgggcttctcgtagcatagtggtgtctgagttccaaaagtgagtattccaagatataggaagtagcgcttgatagtcttttaaaacatggactggaaaagggcacagtatgatttccaccatattcaatacgtcaaagcaatcatggaggtcattaaagtcaagggagagggtgtagatcccaagagattgttgtgtgtttttgtttgtttgttttttgtattttttttgagacggagtctgcctctgtcacccaggctggagtgcagtggtgtgacctcggctgactgcaacctccgcctcctggattcaagtgattctcgtgcctcagcctcccgagcagctgggactacaggcgcccaccaccacatcagctaatttttgtatttttagtggagacggggtttcactgtgttggccaggtgggtctggaactcctgacctcaggtgatctgcctgccttggcctcccaaattgctgagattactgatgtgagccaccgtgcctggccctaagggattgctttgatgtaaaaatgtacagccatttgaaaatggccacaggtggtctctgctgtcaaggacttcagagttgataaagagatagtgatgaaacctatagtaggctgaatcatggccactcaaagatagcaggttctagtccgcggaacctgtatatgttaaattataaggaaaaggagtctttgcaggtatgattaaattaaggatgttgacatggggagattattctggattatctaggtgggccctaaatttgattgcaagtgtcttataagagaaaggcggagagatattacacccagaagacaagaagttgatatatccagatggaggcagagattggggtgatgccactccaagcaaggtaatgctggcagccaccagaagctggaagaggcaaggaacagactgtcccctagcacttctatagggaacgagctctactgacaccttgatttcagtttattgcaaccgatttcagtcttctgacctccagacctgggagagaagaaattcctgttgtttgaagccatttagtttgagatcattgttacaaaagtctcaggaaatgaatacaaacccagacaatgacaagcaagggtggaggtgatatggaggaagcatataggaggcacctgaagcccagcccagctgggagagaagaaagcaggaatgcttctttaagctctgatgttcaaatgagaacacatggacacacggagggaaacaacacacactggggacagttggagagtggggggtgaggggtgggagagcattaggacaaatagctaatgcttgtggtgcttaaaacccagatgatgggttgataggtgcagcaaaccaccatgacacatgtatacctacgtaagaaacctacacattctgcacttgtatcccagaacttaaaaaaaaaaaaaattctgacgttgattcatccctaggaagtgtggcatcatggtgatgttcattcatccctaagaagtgtggcatatgacaacatgtggaacttgaatccattaaacttctttttctttacaaattacccagtctcaggcatgtctttattagcagtgtgagaatggactaatacaaatattatgatgaatgaggacattctcatatcttccacaaaaccatcatggaagacattatccatcatttggttacatttcccttatgtaaggatccaaggggatctggagtactgcttttctgtttgcgtctcaactctgccacatactagctgggtttataggctgctgtgaggtttcaatgagtaaatcaaaacctgtaaacacttggtgcatgcatagtaagtacttaaaactggtattgttataattttcgggatatggtaaaggatattgtttttctggggaaagacactaggcccatcatgggggtaataccctcgtgacctcgtctaacccaaattacctcctccaaatgccattgcactgggggctagggcttcaacgtgtggatttggtggagaaagacaaagacattcagtccataacaattttccttggatttttatgtatatgatcaagtcacctaggaatgatgactgtttcatttcttcctttctggacatttcccccctgtctaactgcactagctaggatatccaggacaatgtggaatggaagtgaggcttatgggtatcagtgctatgataccatccacagggagaaacctttggctttgtatgaaaagctgatgggtagggatattgatatggtttgtctgtgtccccacccaaatctcaacttgaattgtagctcccataattcccatgtgtcatgggagggacccagtgggaggtaattgaatcaagatggggggtcttttccatgctattcttggccagttgtcagcctgcccaacatattgtgaaaccgtgtctctactaaaaataataagccctctcttgcctgctgccatgtaagatgtgactttgctactcctttgccttctgccgtgattgtgaggcctccctagacatgtggaattgtgagtccatttgtgagtccacctctttttctttataaattacccagtttcaggtatgtctttattagcagtgtgagaatggactacttcagatgtcatgatgaatgaggacattctcatatcttctgcaaaaccatcatgggagacattatccatcatttagttacatttgccttatgtaaggatccaaatggaattttttttgaattctattctaagaaaaatcatttcctttcctgtgaacagctatacttccctttgttaaatgatgatattcatgtgtcctttatgttttctttttcttttgctctggctattagggagctaaaacccaagagcacacgcaatcaaaataaccatattaaatgagttttcttatgtatttgataaataaataatttttcttttggtttccctttgggtgtaccttttattgcaagctgtctcaagaagtttttttcacagtaaatggggataaaattattttaaaagaataatacctgacctgattattacctgggtttatttcattgactgaatggtgagactaatgaatggacaagagctttatgaactgtaaaatgccgtgtctgttattaactaggggaagaacatgattgtccttgactttaaccaatgtaccttgtgtcttccttagttggcactgatggttctgagttaggtaaccatgctccctaaagcctctgagatttcccctgagcatcctggccactcagtgcttattttgcaccactcttgtgtgtccaggatgactccttcaactttatctttcttctagaaagttgctatccattgtttacatccagtggctcatgcattcatagactgcagcagcattttctaagcaccagctgctgggtatgtattggttacctgcccagcaacccttttctcttcttctttgctgagaccatcccattttcattcatgcatcagttggcaatatgcccagagaaatggagccccttccttcctcatgctcttaggcatggaactcagttggcccaagccaggcatgctcatcttgtttctctcactgctgactggtttagccttgggcacatgacctggttctcagtagtgagctagtaaggatcagaaaaaccacaaagccatgacattattgaattaacctgtctggaccacctacgcctggattttgtgtgggagatacaataaatctggattataggttggtgcaaaattaatatttaaatcacctgtagttcaactctgtgttgcttgcagtcaaaagtatccttatcaggctgggcacagtggctcacgcctgtaatcccagcattttgggaggctgatacaggcggatcacctgaggtcaggagtttgagactagcttggccaacatatagtgaaaccctgtctctactaaaaataaaaaattagctaggcgtggtgacacgtacctgtaatcccagctactcaggaggctgaggcaggagaatcgcttgaacctgggaagcagaggttgcagtgaactaagatcccgccactgcactctagcctgggtgacagggcgagactccatctcttgcaaaaaaacaaaaaaagtcctaatcaactgttttagtttggatgctcactgaagtagactctgaggcaaggatttgagtgccaatagtttattaagcttgaggaggtgggggaaaggggacaggcaagggagggaagtggcaagaaagatgcattatcatgtcagttaccagtgtggggaatcacagtttaatctctctggggaactctggaaaatgacacagagcagggatttgcaaactattggcccatggcaaacctgttctgccacctgttatttcaataaaatgttcctggaatacagtcacaccctttcatttatgtatagcccatggcagcttttatacaacagcagcagagttgagcatctgtgagagacaatatgacctgcaaaacataaaatatttactatatgaccctttttcaagaagtttgccaaccctagtgttgagcatgtagctcagaatcaccccctggaggagtgaaggagctgggatatttatacatccctccagttagtcactggtgaagacctaatgcaggaggtatgttaattctccaggacttccgacctgtcctgtgcacaggcattgtgggccctggccaagcaaagagatgtaaataccgattgttgggatttgtgcaagtatggaccctactggtccataccagtacactaacagagatggccacatcagtgcatccagagatggctgagaagtgcacctgtcctccaggaacccatagtctgaaggcaaggttggaaatggccaaacatttttatttttattttttttgagatggaatctcactctgtcacccaggctggagtgcaatggaatgatctcggctccctgcaacctccgcctcccaggttcaagtgattttccctcctcagcctcccaagtagctgggattacagggacctgccatcatgccggctaattttttgcatttttatagagatggggtttcaccatgttggccaggctggttttgaactcctgatctcaagtgatccacccacttcagcctcccaaagtgctgggattacaggtgtgagcaatcgcacctggcctttatttttattttgtgagacagggtctcactctgttgcccaggctggagtacagtggcacagtcatagctcactgcagcctcaaaatcctgtgctcaagtgatcctcccacttcagcctcccatgtagctggaaccacaggcctgtagcatcctacctggctaatttaaaaaacaaacaaaaaaaaaaacaaaaaaaataaagtgtgtagagacagtctcactgtgttgcccaggctggtctcaaactcttgggctgaagcattcctcctgtccccgcctctcaaagtgcttgggattacaggtgtgagtcactgtgccctgctcaaacattttataattaagtagaaaaaccgacatgtcagctggggtcccctgaatcctcaaagatctaggtaagatcttctatgcaggctacttcctgctaatctggggagggcgaccttctcaaggtcgtatctgcctctggccctggtgcccccaacccacgctggctctgctttttcccctacaggagcttaagtgcagaactttgcgtctcccattgcctgcaggaaacctactcagctagtgagttcatagggcttcactgaagactgggggattctggaggggatgattttctggcacattcaggcttctagaaccctctattctttccccagctctgcttctcgtttttttttttgtctggctccaaaaccttactccttttattgagcacattatttctctccagttcccacctctgcatttcctttcctgaatgcttctagggcctcagcagaacaaggaacgcctcattgatgacgttaaaaaacaacaacaacaaaacaacctaagacacaagacacagacaaaactttttttttttttttttttttttggtattctccagacaaaacgtttgcagcatgagatgaggtcccctttggaaacatctccccacattctgtgattctgccaagtcctctaaattttgtctcctccttcatccaccaggtggatttcaggactcctactgtcagaggcttggaataaacctctggcatgctttgcttctgttttgctttctttctttctttttttctgagatggagttttgttcttgttgcccaggctggagtgcaatggcgtgatctcggctcaccacaacctccatctcccaggttcaagtgattctcctgcttcagcctccagagtagctgggaagctgggattacaggcatgcgtcgccacgcccatctaattctgtatttttagtagagatggggtttctccatgttggtcaggctggtctcaaactcctgacttcaggtaatctactcgcctaggcctcccaaagtgctggggattacaggcatgagctatcgcatccggccctgtttggctttctaaaatagactgtgtgtctcacccagcatgacgttagatctgtttagcatgacagcattccattgagtcaactccttggacatactatatgttttgtttccctggtagctaattaaataagacaactaagtgcagtctagaaagttcctctcataacaaagttcccaagaatttacgtctttgctttacttacttactttttcgtggtagttgaagttcaagtggaaactgattataaaggagaaacctaaatcaagttaggtgaattctgcagtatgaactgtgcttggaaaatctaactggtaatgtatccacattgggaacttggtccttcctctcacaaagaaaattccaggtcaatttcatcccctatgctaagcatttgagtgttcaggaatgtgattttagttttataaaaattgttctttttaaaattcctgtcaaataatcagatttttttctcagcacatttagaagtaaaaatggaaagtttagagcattttgatattttagtatttccatgaagtcatttaaccctcccagactagtttcagagttttgtcttccagcccatctttgtgtctcactgtacattttctgcatgtacaatgagaggtgatttttaattggaatcccttagatttttagagagaaagctctcctcctctattcttcttcctctcctctcactgtctctcattttaatccagagaatcaaagtgtctcttacaggcttggatatcaagctgaactgttaaaaacagtggggtccaggaacctgagtttaaaacaagcacctctgattgtctaagtggacttagagaaagacaaatgctgtgtgatctcacttatttgtggaatttaaaaacgttgaactcatacaaaaagagtagaattagctaagtgaactaattcagacagagaaagacaaatgctgtgtgatctcacttatctgtggaatctgaaaatgttgaactcagaggaaaagagagtcgaattagaatggttgccaggggctaggaggaaatgttgctcaaagggtacagactttcggtgataagatgaataagttctgggcatctcatatttggcacggtaactatggttaacaataccatattgcttacttgaaatttgttaagagagcagctcttaaaattttttttttactttttgtgggtatataataaatgtatatatttacgggtacatgagatgttctgatacaggtatgtggtgtgtaataatcacatcatgaagaatggggtatctataccctcaaatatttatcctttgtgttacaagcaatccaaatacactctttcagttattttaaaatgtacaattaggccaggcgtggtggctcacgcctgtaatcctcacactttgggaggccgaagcaggtggatcacgaggtctagagtttgagaccatcctggccaacatgatgaaaccccgtctctactaaaaatacaaaaaatgagccaggcatggtggcatatgcctgtagtcccagctactcgggaggctgaggcaggagaattgcttgaacccaggaggcagaggttgcagtgagcccagatcgcgccactgtactccagcctggtgacagaccaaggctctgtctcaaaaaaaaaaaaaaaaaaaagtgcaattaaattattgactatagtcactctgttgtgctatcaagtagtaggtcttttttttttttttggagtgaagatctcatttctgttacccaggctagagtgcagtggcatgatgacagctcactgcagcctcgacttcctgggctcaagtgatcctcccacttcagcctcctgagtagctgggactacaggtgtgccccacaatgcctggctattttttgtatttttagtagagatggggtattgccatgttgcccggctagtcttgaaatcctggccttaagcgatctgtccgccttggcctcctaaagagctgggcttacaggtgtgagccaccacacctgaccaagtagtaagtgttactcattctttgtaactatttttcttgtacccattaaccatccctacattccccagcccactacccttcccaggctctggtaatcaccatcctttcactaagagaccagatcttaggtgttctcatcacataaacatccaaagacaactatgggaggtaatgaatagggtaattagctggttcatggtgatcatttcacaatttgtgtatacatatatctccaaagatcacattgtacactgtaaatgtattccatttttatttgtcaattttacccctctaaagctgggaaaatgaaataaaataagcatcctgggcaggactggctgcatagttttcagggcccagcacaaaacgaaaatgtggggattcttgttatgaaaattataggaattctggctgggtgcaggggctcacacctgtaatcccaatacttttggaggctgaggctggggagttgctttgagtccaggagtttgagaccagcctgggcaacatggcaaaactgcatctctacaaaaaaaaaaatgaataaattaaaaaataaataaataaataaatcagccgggaatggtggtatacatctgtggtcctagttactcgggaggctaaggcaggaggaccgcttgagcctaggaggttgaggctgcagtgagccatgttcatgccactgcattgtagcctgggtgacagagaaagaccttgtctcaaaaaaaaaaaaaaaaaaaaattataggaatttcaaaatgccagcatcacagtggggtcgtctaattatggggccttgtgcagttaccccaggcagcatagcaggaagcctggaagagctttgctgcaggattcagatcccagaccatggtgcccatgagtttcaagatcttgtaacatgaaggcgtgtcttcaacagactctctccaaagaaatcctctcttgctcttggcccttctttgtgcctgaaaagcgtgagaagagggtgtaagcaggacagaaccacttttatttttatttatatatattttttgagatggagtctcgctctgtcgcccaggctggagtgcagtggcgccatctcggctcactgcaagctccgcctcccggggtcacgccattctcctgcctcagcctcccccgagtacctgggactacaggcgcccaccaccacgccccgctgatttttttttttttttttgtatttttactagagacggggtttcaccgtgttagccagggtggtctccgtctcctgacctcgtgatccgcccgctttggcctccgaaagtgctgggattatagtcgtgagccactgtgcccggccagaaccacttttcaaagattttgtttgaaaatctgccttttgattttgtacttgattttggaattctttattattattattattttttgaaacgaagtctggctctgtcacccaggctggagtgcagtggcgtgatctctgctcactgcaagctccgcctcccgggttcacgccatcctcctgcctcagcctcccaagtagctgggactacaggcgcccgctaccacgcccggcaaattttttgtatatttagtagagacggggtttcaccgtgttaaccaggatggtctcgacctcttgacctcgtgatccgcccgcctaggcctcccaaagtgctgggattacagtcgtgagccaccgcgccgggcctggaattcttgatgctttaaacaaaacttaacatcttgcctgacatgtttttgtagcccaacaggataactaaaacgccagcattaaaactcagtccctggcaagatgttgtctgtgatctccttcatcttcacgacaagatcatctagggttgtatgctgaggttagcagcagagtctcagtggagtcgaccctgcaggtgggaagccacacttggaattcctccatcgtgcttagttcaccttgaggactaggtagctatctaatggcagaatggtttcaaaacccaagtatctgtgaagagctttctcttttgtgaattcttcggtccagctcagtgacttccaactgttcgaggggcatagttatgacttaaaatgattacatacacaagtacatgcacactctataaattatggttgatttaaaggaatctcaggagtaattttgaccacaaataatttttcctcttctgtactaactatggaaatgaaatgtttgtgtaatatatgatttcattttgccagaatatatgaatacttctgtgaaagtgtcctgaaataaatgaaatgctgtctctgcaaaaaaaaaaacctaaaaaacaaaaacagttctttggctgtgacatggacatgaataaaaaggttataactagcatcaaattcaagcatttggttttattgcttatgtgaacacagcatggaacatcttttgattcacgttttccccattcttagtcgtgttatctgttcgtgactatgcaagtggttttgtctctcagggacatttggtcatgtctggagacattttcagttgtcacaactggggatgaggaaatggtgctactggcatctggtgcgtagacttcagggatgccagtaaacatcctgcagtgggcggaatagccctgcatggtagagaatgatccactctagatggtgtcagtgccctctaaacattacgtcctgggctgtacccactctctggatgtgaaaatggaggcctagggaggctaagcacttatttattatttctttgtagttaaaaaaaagtccatcttgttccaggaaggaacaatttactttctaaacatgaggcataaaacagaaataactaggaaatcggtggaaatgtgttttcatggggaccgtgtagactgaggacaaattttcaggcttctatttgtccggtgaggttagtgcttgtgcgctgggccaagtcaacatcctcttagcggtgtcttgtctccttcctgatttagaaaaggcaaacccacctgctgtcatgaaaaataccttctagaagctaccgggtaattgggtgatatttctggatttgtctccctgtctaatgtacatcagttaaacttttgactcttcagtgccttctggagaaagtaataatcggaaactaaatcgacttggttttttctctccccctttgccccgtatttgtaaagattaatcttcagtatctatgagtgctgggtgatttgcggaaactgcagctgctttgtcaatatcagcttggcctccattgatcaaaccctcatttaggcgttcactgccgtctgctggaaacagcccagggatgaggagggaagggaaaaggccacttcgggaggccaccttgccttggagtttccgtcgttttccgaggtgagcttggatgtcactgctcagcacagttgattaaagaggttggtgctgtgagtgagtcactgtgtgggaatcaatcccgatggtggcagatatgaataaagcgtcggtgtaactgtcctggctggattgtttttctccgtctcaccatactgttttccctctgcacgtgtctgtgacctccggcaggcttgcagataaaagtgatgcatcttcattttgtcggaggagttaattttgtgtgtattccaaggtaagatgatactcacggtgcttatatcttgggcacccactgtgcattggacactttccataaattaactcaaatttttcttagcagcttgctatggctcttcactgtttctccaattcgatttacaaaaccttgatttcagtgggatccctgtttgctcttgcaaactcttcactcaccacctgctttttgcccactccacttcagctgccctgaactttgtgttgctggaattgactttgctcactcacacctctggtcctttgcacatgctgtgccctgggcttagtacatttcactttcatcctcttaacctcgttcatatcttgcttgggacaacagatacggctgtaagtatcagaaaactctattatcatggcttgaaggtgcaagggtttatttggcttacacaataagctaaacagtaggcaagccatgttggtagagtgaatcaaagagaccatcagaaacccccacttttttcattttcttgctctgctgtgcaatttctatcctcatggttacaaaatagctgcttcatctccaggcatcacgtcagcaggcatagaagccaagggagggcagcaagccagaaaactaaaggtgcgctctcccttcttttcactggtcacaactacgtcagatggccagccctagctgcaagagatgctagtgaaagatgatttttagctggatacattgtcgccctcagcaaaataaagatgcatttttcttattagcagaatcctaacaattaagattcagtgctcagttttgatgccactcagctgagtggtcctccctgaatccctgtgacagagttgggacacacaggtattaggcaatctcatagatggcattggagttacatgaaattgtggtcttgtttccctatctggattgaaagctccatgaggaggacttggtctacctttcacacagttgtatctctactacctacatagttccagatatatagtagatgctcaataagtaataaatgaaggagttacatgaaattgtggtcatgtttccctatctggattgaaagctccatgagaaggaggacttggtctgtctttcacacagttgtatctctagtacctacatatatagtagttctagatatatagtagatgctcaataaatacttaataaatgaaaaatagctactattttgcccctttgtagttgacacctagagctttagggagataagataacttgccctaagtaacacatgtactccttaattcctccattcagtaatgtttatagtgcaccttctatgagccaggtcttgtttcagacacttgggatacatcagtgaacaaagcagataaaacgactgcctttgagaccattatccctaatattttattacaaaaaatttcgcacatacagcagagttaaaccaatttcatagggaacacgtgttcagttactacctaggttctaccagtcactggggcacattgataccagtgggggaaggcacacagtaaaccggaaacaaaacaagtaaattacatggcattgtagaaggtggcaactgctatgagaaatacagagaaggtaacggggtgtagggcgtgcagttcggggtggtggtggtggccaggcttggcctcattgagatggcgacagttatgcaaagacttgaaggacatgagggagcagtgtcgatattggagggcaaagcagttctaggtggaggcaacagccagtgcaaaggtcctgaggtgggaatctctgttccaggaggggcaaggtggaatgtgtggttggaggaggagcgttgatggtggctgggttagtagaggaggaggagtttggggaaaaagatcaagggaactcagctttggacaggctatgcttgaacaactcaggggcagagctgggatttagatcccagacctcacaaccttcctgtattagggttctctagagaaatagaaccagtaggatatatatgtctatttattatatggattgttgtatgcagttatggaggctaggttccatgctctgccatctgcaaggtggggtatgaggaaagccaatgacattaagtcccagggtaagtctgaaggcccaagaaccaggagctctgatctccaaggtcaggagaaggtgaatgtcccagctcaaatagaaaatgtacacttcctttgcttttcgttctgtttgggctctcaacagatgggatgatgtctgcccacatgggtgagggtggtcttctttttttctttttttgagacggagtcttgcagtgttgcccaggcccgagtgcggtggcatgatctcggctcactgcaagctccgcctcccaggttcacgccattctcctgcctcagcctcccgagtagctgggactacaggtgcctgccaccacgcccggctaattttttgtatttttagtagagatggggtttcgccatgttagccaggatggtctcgatctcctgacctcgtgatcggcccaccttggcctcccaaagtgctgggattacaggcgtgagccaccgcacctggctgagggtagtcttctttactcagtctacagattctaatgctaatctcttccagaaatgccctcatagacacacacacccggatgtaatgttttaccagctatctgggcatcctttagctcagtcaagttgacacatgaaattaaccgtcacactttaccattttgccaacatctgtcccccagtcattcaaagacactgtgaccagctggccaggtggcaagaattcctagggcacaagcctgaagccttcgggagaaacttcagctttacagggggcagaatgtttggtaactatttagatttaaagcagaagcactttggattgagcaatttcatatgtgacaactgtctttgccacaagcaacagcagagacctgcagatgagaacacctttatgaagaacaagaccatgctttgaagttgggcagagatcttggttcaaatcctggctctgctgcttgttagctaagtcacttcaggtaagcgatttaacttctttgggccttgctttcttgatctgtcaagtggaggttcataatagtatcaccccttgagggcagataaactgatgtatgtttatgcatacataaactgatgtatgtgatgtaatttagcacggtgctggtccacaggtgaatggagatgatttttgactttctgtctcgcagaaagtctgtacctccccaaggacatctcatgcccacagcagcccagcattgagtcctcaccaacccagactgactttccagcctcatatcctcaaaggatctgacattttccagccaccaaccttggtttgcactatgcccttcatcaaaaatgtctttgcttctctttgatgcctgggtatctattcctttagaacccatttcaaatttctcctccttaaagatgccgttggtcactgttccaatctgtaggatactctgttttgcccagatcccttttgcactgccttctgggactcagatacagagggggcaaaacatcccggaaggggtggggcccatggactgctcttggagtggggacagagatcaccacgagatggcgctattgagccatcactgtcaactggtttttctctgttttcattttcttacttgatgagaaatgtgtgatttccaaatagtcccagaaggaatagaactgtgactgtgtcccaccactaaaaaggtggttttgcatatctctgatcgtcctatcacatcgcccactgttaaaaattccatccccacatgcaggggatttagaaggagaatatcacacacttgctaccacccccaatccatgcaaataccttggtacttgctatagacacttggtacacaaatactgcctcagtcttttattaaattatattttatatattgcatcagagtattaagcccttaagggtaggacctggggtccatgccaacttactagaacggtgtcgacttctctaggatatggaatccacacagctccttggaaagctggaaaatgcagttttgaagcaaccctgcttcatttccacaccaatggaaaggaaagtgataaatcctttatggccaagagtccgttctgtttatttcttcctggaaatgctattgatggtggctggggaagttgtttgttttttaatctttcccttggcaaggtctccttactcatagcccttccttatgttccccaaatggtgcagggggcagtgttcagaagcccagtatgcaggtcttgcacagaggagaattatggcttaaagaaacttggctaagtgtggtggctcacacctgtaatcccagcactttgggtaggtcaaggcaggccagatcgcttgagtccaggagtttgagaccagcctgggcaacctgatgagaccccatctctacaaaaaattagccagggatggtggtgcatgcctgtagtcccagctactcaggaggctgaaatgggaaaattgcctgagtccgaaaggtggatactaaagtgagccgagattgtgccactgtactccagtctaggtgatagggtgagaccctgtctcaaaaaaacaaaacaaaataaaaaccaacaacagaaaaagaaacttgggtgggatcatgtgtccaggcctcagcactgttgtcccttactctaactcctgcagagaggtccttgaacagacgtaagcggacacaccttgaagtcaaggtgctctttgcaaagcaacacaatgttattgacatattccatttgaataaccaaattttgtagttgattgtgcgctaaggtggatacgcattacattatgttcttatgtagggaagtagaagttagtgccgagatttaaagaaaaatcagtggggaaaataacagttgaatcttatttgtttaaaaacttaggacttatttattcttctgtccacccattcatatatacatttaacaaaagtatttgaaattagttttatattgctatttattttaaaaataggtattatacacgtatggctcaaaattggaaagatacaaaagagtgtatagtaaaaggtagtttccactcccatccttgtcctaaccagtttgtttcttcacagaaatggcaaccactattgatagttttctatgttccccttgagaaatattctatattgtaaatgtatattcatgtattcatttattcacccatctatccatttattcatctacccatccatttattatctagccacctatccatagatggatccatttatgcatccatcaatttattcatctatttacccatccatccattcatccatttatccatccatctatctatttactttccattaatctatccattctttcatccacttatccatccatctatccatccactttgcattcatctatccattcattcatccatccatttatccattcattcatccatttatccatctattcatttacttacccatttatccatccatctatccatccacacacacatccatttatccatccatccatctattcactcatccatccatttatccatctaatccattcattaatccatttacccatctatgtcatttttttccaggaagaggaaaagggcagccattatttggttttagatggtagaccaaatttgtgctactgttccactggaaaagagatttggaaccactccttggcgttaagccagccactccaaagctgtagtgttgcaatgtcatacatctgtcagggaaggctgaacattttaaaaacaattgggtatggccattcagattttattttggcccagcataatgagtttgtgtttgattctgaaggagagggagatttgtaataaatcagcaagtgaaattaaaagtgagccagtgaggtgccataaaagggtggttggaatcagacattctcaaatccatatcctatccccacccatgttaaaagctatataggaggttatttaacttcttgggagtctcaattttcctcttatgttctgagatggggataattgtatttttctttgcaggttaaaggctaacacaatgcttggatatagtcagtgctcatgtggtaactgcccttaacattattaagcccacataattctcttcttttttgtaagcagttgagatctttaggttgaagattcaatatacaatgtaacagagtcagagggtgggtggcaaaaggtacatacatactgcagggcagggacttggagtatggaatggagaaatagcagaggacatcttccagctgcagttgggatgggtgctgagctacaaagctactagagaaataggaaactcaggtctcatcattgcagggacccttgtttcctgcaaagaatccttggagaaatctctcccactgtctctgggcattgtattcagaaatgtctggcctggatgatagtcttcctgcttttggcctcaccctctatccactgtcctctgctgaatctttctaaaatgcttgcttaaaactccttatctccttcaggagaaagttaaatcctttaccacacaaggccattacctgggggccctttctaactcctcccacctcaattttgtcctctttctgcaggtatctaagtgtcatgatttagatgtcctggcatgcactgtgctctttttctggaagcctcctttctttcttcatccaactacctcctcttcttccttcgagattcagctgagactctcttgagcaaattttccaagactccttaaggggaaggacctggtccaagttgacttggtgtctccgtcatcaagcacaatgcctggttcacaatggattcttcatgcatctctttctacaagatgagaaggatcagagggtgaggattggagctgggtgtcttaaaaatctgtgagagtggaagctaagccagtgatgtttgctttgtaagctattcttgtgatattacaatccttcagagtggtgaggttggtgggagtggtaaaaacaaacaaacaaacaaacaaaacctagtttctttgtcttggattttcctgtgtcagtttatagagagagactatccatcatattttattttagcttaaccaaagtcctactttttgttgtttctttttttctttgctgggatcttaaaagagattgaataaaaattcagttgtaggaatggctttaccttcctctctggtcttgttgttttgtttttagactatgatatcacatgtcaagactatgatatcatatcaggactaggatatcaagtttataatagaacaataattatgtattatttaaacttattttcatcaaactataactaatacacaatggattttttaatggtatatacagatatttaaaatttgaaataattttagatttatagaaaagttacaatgatactatagcaagttccaagaaatcccttctcagtttcagtttttcttaaattttgttgttgttgttgagacggaatctcgttcgatcaccaggctggagtgtggtggcacgatctcggctcactgcaacctccacctccttggttctagcaattctcctgcctcagccccctaagtagctggcactacaggcacacgtcacctcacagctaatttttttatttttagtagagacgaggtttcaccatgttggtggtcaagaccaccaggctggtcttgaacttctgacctcgtgatctgcccacctcggcctcccaaagtgctgggattacaggtgtcagccattgtgcccggcttctttaatgttaaaaaaatgttaatgtctttgtcacaactttggaaactattaattgcattccaaattttatttgaatttcaccagtttttctactaatgtctttttcctgtccaggattcaatccagagtttcatgttgcatttattctcacgtctctgtagtctcttctggtatggaacaatttctccatctttccttatttttcatgatcttgatagttttgaggggtactgggttagggattttgtagaattggacttggtgattagaacctaggtctggccgcctacccatcacagtatcagtaaaagcctcccttgaaattgaccaatggcatgaacatttcagatgagtctgccatctttggtgctcctgggacacgagagagacctgtcttggagacagagacctcacagactcagagattcaggtgctttttctggtaatgattttgtctgcgggctgatcacaaaggtggatgagactttggccaaagctaaggctgcagggtctgggctaaaaaattccagaaaaactaccttgccatgggaggctgagttccaaatcgcagcccgcgtgcagcctgctttaccaaataatgaggcactgggtgctttttaaggcagctgacctttggagcaaattatccaaggaaatctgattagctagttcactgggttcctgcaaaatggagcttggtgtgtttctgcagcagaaatgtcagcataattggagtttctggagctcaaagagcttctttcttattgtttccatcctttggaggaaaaaaaaacaccccaaacaaacaaaacccaaacccccaaagaattgttctttgacttacattctttgcttttgcacatggttcagaagctgctcctgactgtgtttacgactttattaatcaggggaacagcccgaacatcatttaaacaaacaaggccaaaaaaaaaaaaaaatccatccctaaacagatgatgtgagcttaatagagatggccaagccaaagaccttaaataaataaactgactttaatttgtaggaaggagcatggggtggtcattacttgaggctgtgtgccatgcgatgtaaccaaatttgaaactcgctaatttcattattttaatggaagtctgcctcccattcattaggctgacatatgactagccattagtaacagtccatttccaaagctatggtggataaagggtgattggaaatgagcgagggccaggcctggtggaggctggcaatttcagaagggaactggtgggtgggatttatgcaagaggcagggaacacaactaggaaaattgtcaatgtggatggaggcagcaaaccattgagtccaaatacaggcttgagagacctgggtttgaattctggttctgccacatactggctgtgtgaccttgggcaagttacacccccgcactgagcttcagtttgctcatctgtgagatgggagtaatcatagttcctatctcgtagggttgcttgcaatgactcaatgaggcaaattcttaggaggctctagtatagggcttggcaaaagtaaccacttaataaatggtagctatgatgatgataacgttggccaaagtccccagtatttagggacttggagattttgctaatgaagaaatgaaggctgacagaaataaagtaaggtatccaagtttgccccgaacttggactcaaatttctgattcttaatcctatactcttaaaaaaaatcctatactcttaatcctatactcttaagacccgtatttttaaaattgtttcatttcttgaacaggccagtaattcatatgattgaaaaatttaaaaacaagagtatgctagaatagtcagtgaaaattgtcccttctgcctggaacatttccttttcacagacagccattgttacgtgtttcttctttatctttgcagaatttcaggtacgtacaagcaaatacaaatgtatatgcacttcttttttttttattacacagacagttctgtatcctgccttttaaaacttatatcctgcttatctttctgtatcagggtatagtgagttctttcattcttacttataattatatgtttttctattataatggctatattatgtcttatttaattatttctctcttgatgaacagttgggaaagttctcatcttttgctattacaaaccacaatgcgatgaataacattgcatgtatgtcattgtgtacaggtgtacgtatattctaggataaatttccaaaagtagaattgctgagttacagagtgaatgcatttctgattttgatagtgctcaaaggtctgggggcacatagagatggtgctttagcagtgagcttaggctgacagcggttaagagagacatgcctcaggttgccagttaaaaaaaaatctgcataatgtgttgcttaaagaatgtggtaaggtgaaagcttggaaatactggtgtcattggaaagacagaaataagacagagattgtgttgggaagagaacacggaatttcgagtaatttctgcctgggtttgcatcttgaccctgccactcctggctgcatgaccttgggcaggttgcttcacatctctgagctcagtatcctcacctgtaaaataaagaccatgataacttccattataggctgctggaggaagtaaaaaagaaaatataaacagcagttagcatgatgcctggcacatggtgtgcattcaggatataactggggcctttgggtgagtaaccaagttcataatgactcatagctagctaacattattatattatatatactatactgtattagtgggaaatagctaacatttattgagtgtttactgtgtggcacgcactgtgcttactgcctcccatgaaacattccacttacctctcataacaactctgtgaagtattcttgctcacctcagcttacagatggggaaacggaggcaggacactcaagtactttgtctgttgaaacactgtgaacaaacgacagagcttatatttgaactgaagccacttgtcttggagggctcctctgatcccacatcctgttctttttttttttttttttttgggagatggagttttgctcttgttgcccagtctggagtacagtggcgcaatctcggctcactgcaacctccctctcccaggttcaagcagttctcctgcctcagcctccggagtggccgggattacaggcacccaccaccacgcctggctaattctttgtatttttagtagagatggggtttcaccatgttggccaggttggtctcaaattcctgaccacaggtcatccacccacctcagcctcccacagtgctgggattacaggcatgagccactgcacccagcccatcctgttcttttgatccacgtattataacataagaggctgacttattctgagacaaggacatcatgggtggagcccccttctcatctcggtgtgacctagttcagcttccccatctcttaggcagataccattgggttcagaaaggttcaaggacactttttctcctcttagcttagtgcttcctcaagtgatccatgacttatgaccttatgacgatgccgtgtggtgagtctgaaatcagatgaagatttttatcccgacatgatgaacacaagcattgcataacctgactcgggttacccaggatctttcctctgcttgtggtcaccactgctaggattttggaagaaccctttaaaaactaagctctctgaggacaggcatttttgtttggttcactattgtgatgccaatgattagaaaaatgcctgggcccataggagggactcatgttcaatgcagaggtggataaatgagaaagagactgtttgccgcagaatactaagagattttattgttcttgtcataggaaccaggcaatattccagacacacatgacatcagtaacatccatatgtctgtgatggggtaggagagaagactacttttcaggtgggacattttgattggagagggtctctgattcagagagtgaggtgagctattttcttcttgggagttcttggcatttgataatccttggtgtttatttcaaaatatggaagaatttgagatttacttagacatcttggcatgcagtgctaaacctcagacttcctgaatttatttaccagctaggggaagcatattcccaactttaattgtatttacaaagggctctaatctggtgtgaagtctgaaggcatatttgttgtaggagttactcaattagccagtgagaaaagaacaaaggaaaagtcattatgcagatgtatgcccattcaaatctattccgcctctagatgctttcttcgtagtgaagggaagaactccagtctgcaagtctctcgtctctgctgtgttttctgctaattctcttctaatattaggccatgaatgattaataatattgcattttgacactgttagattttgtcaatttttttcaatataaaagcagataattacagattactttaacatccaggaagtgaaatcaaccatgaattacactcagactcatccacgaccccttgaatatctgtcttttttttttcaataggagattgaagtttctttagtcaattacacaagtcatgtctgacaattgagaaaatgctgttcacataaaacatcataaattaaaaatatacagtgtttatattttaatacagtagggtcccaggattcaaacaaagaattttgatctcagaggttgcattatgtagttatgtgttctgctttaaagaactatactggaggtaaacttgaaactgcctttgcagaaattataactgaggaaattatgacagtgaaagagatcagacctaaccaactacaccttttatctaatcttaaagctatccttattcattcctgggcataggccgaaataaccttgggaaggaatttagtttacagtttgactctgaaacaaaattgataatagccgtttcctgaaaagacctccttcttgcctggtgaccagtctgcctttgtaggactaacaaattggctacaagattggaaattatggtttaggggtcatgcagcccctgactccaagagtctgaacctccccagattgctcctagggatagcgtcattattgtaaaacttaagatcagtgcttgagatattttgcaaaccctgcactcagtggatcagctgacaccacccagactggtaacttggctcccagttctgccatcccacccaggaacagaagaccacaaaaaaacctcacttcgaccccctatgataccatctccaacctgaccaatcagcaccacttcctgagccgctacccaccaaattatctctaaaaactctgatccccaaatgctccaggaaggctgatttgaataataataaaactcaggtctcccgcacacgtggctccgtgtgaattactgtttttccactgcagttcccccatcttgctaaattggctctgtctaggcagggggccaggtgaacccattggatggtatatttctcaagagtcaaatattaataggtttaacatgtaagacttacatatgtgtgtgtgtgtgtgtgtgtgtttacatatacatatatttcaatagcttttggggttcaagtggtttttggttacatggatgaattataaattatatagtggtaaagtctaagattttagtacctgtcacctgagtagtgtacactgtacccaatatgtagtttttgtatccttcattcccttttcatcctctcctcttctgagtctccagtgtccattatatcactctgtatgcctttatgtacctatggcttagttcccacttataagtgagcatatatggtatttggttttccatccctgagttatttcacttagaataatggcctccagctccatccaagttgctgcaatgacattattatatcattattttttcatggctgagtagtattccatggtgtatatgtaccacacattttctttatccactcattggtcgatgggcacttaggttggtttcatatcttgacagttgtgaatcctaaattttacgtgcaaggttttgcatctgtagaggaagacaggattctcagtgcatgtgccaatttttgggttttccacttgagaatcttcaccagttttctcttcagaatcaaattcctgactatctggtgcttcagagttatccagaggttcatcattcagtctctgggttgcctctgtcatatactgtactctgccgcttttgccaattgtttactctccttttccaagtggtcaatttcattgttctttcttcaatttctctgtgaagcctctcattttccttaagtgtttcatagagggtgttcctttgttctgctacttctctccaatattgaggggataaatttcatttaatcctaaaatcaaatgcttcttgggtgactcctccaagattttaattgtcactctattctgggacaatgacaactctagagtgggaagtcctggctgtcaactggtcattccaatgcttcctcttggatatgctttgggccagtcacttttttttttttttttttttccgacaagagatctggctgtggaaggatgaatcatcttcagagttcttcttggggagaaactgttctttacatctttgattcctccttgtttctactttatcctaggattcattatacagctggtaaagcacaaaagatgggaggagaggattaatgatcatagtgaattcaggtgactgtggcacagccaacctacattgatccccactgtcgctggagtggctggggcacactgctgaaaagacttactcctcttgaacatactcctttgagtagtttttatatatgtaattttgcatatttttttcattttttttattattatactttaagttttagggtacacgtgcacaacgtgcaggttagttacgtatgtatacatgtgccatgttggtgtgctgcacccattaactcgtcatttagcattaggtatacttttaatcgtagtgccatacaattgtattgcattttccatttatagcatattataattattttgacttttattatgaaactttcaaacagaaaagtagatagtataataaaataaaataaaaagtatatatataacaagtatgtcggctgggtgtggtggctcatgcctttaatcccagcactttgggaggctgaggcaggcagatcacttgaggtcaggagttcgagaccagcctggccaacatggtgaaatgctatctctactaaaaataaaaaaaaattagctgggtttggtggtgggtgcctgtaatcccacctactcaagaggctgaggcaggggaatcacttgaacctgggaggtggaggttgcagtgagccaagatcatgccactgcactccagcctgggcaacagagcaagactccatctaagaaaaaaattatatatataacaagtatgtaaacaaaatacataagtaaaaggtagaataaaaaaagatagcataatacacacccatgtatttattgcttagaattaacactaatattatattttctttgtgcattttttttcttaagtggttcaaaagaaagtacagacatcatgatattaaaccctaaatcagtggctctcaactgaggttgactttgacccttgtcctccgcaagaggacttttggcactgtctggagacaatgttggttgtcacaaaaggaagcatgcctgcatccctggtagagatcagggatgttactaaacatgctacaatgcacaggactgccccctccaaaacaaagaattatctggttctaaatgccggtagtgctgaggttgaaaacctttggtctaaatgattaagaatgcgtttcttaaaatgcaaaatttcacataaccacatagcaccatcacttctaacaaagagaaaaataactctttaaaattgtctaataaccagtccatgtttccccaccattccactaaaatgttttttacagctggttttagcaaacactttccattttattagcactgttaatagaatctcactctaaatgactacagaatagtctgttaaatggattccctgaaatttattcaaaggatctatttttggatattagttttgcttccaggttttagacaaattatatttttgtaaataatgagagtttacttcttttctaactttgtgccttttctttcttttatttgccttatgttctggctaaaaacttcagtaaatactgaacacagcatatgagagtgggcatccttttgttgttccagattttaggagaaaaagatttaatattttattaagtatgatattaactgtaggtttttaaagatgaacgttatcatattggagatggtcccatctattcctagtttcactgagcgtttttatcataaagaactaatgatttctgtcaaattttttttctgtgtattttgaaacgatcaaatggttttcaaactcttactctgttatagtatgatgaattatattgattgattttcattaaaccaaccttgctttcttggaataaaccttgcttggtcatgatgtattattctttatatgtatgtataaatatatatctatagatacatatacatatatacatatatctatctatatatatagatatgtatacatatatatatagagagagctggattctgtttgcaaatatttggtttagaatttttgtgcctatgggctgggcgcggtggctcacacctgtaatcccagcactttgggaggccaaagagggcagatcacgaagtcaggagtttgaaaccaacctcaccaacatggtgaaaccccgtttatactaaaaatacaaaatttagctgggcgtgttggtgggtgcctgtaatcccagctacttgggaggctgagtcaggagagtcgcttgaaaccggaagggggaggttacagtgagtcgagattgtgccactgtgctcctgcctgggcaacaagagtgaaattccgtgtcaaaaaaaaaaaagaatttttgtgcctatgttcgtgagggattaggctgttattttttttacttgtaatagctttgttatattttggggtcagggtgatgctggccttctatattaaattgggaagtgatacctcttcctctatgttccgaatttgtgcattattgatatttctcccttacatgttttgtagaatttactaatgaaccatatatgtggaaaattttctttttagaaaggttttacaaatttaatttctttaatagccatggggttatttattttctgtgtcttcagttgttagtaatttgtgatttggattaattaatataagttgttgaattgttagaatgttttaatatttatcctttttaacatttttagaatatgtagtgctgtttcatttttatttatgtgggcaatttgtgctttccctcttttttttgtccattgttgttaagactttgtattgccactttactattagtatttcctttcttttacttgctttagatttaccttattcttctttttctagcttcttaagatggaaggttgtatatacctttcttctccagtgtaagtatttaaagtcataaattttcttctaagcactgcgttagctttatttcacaaattttgatatattttcatattattcagttcaaaatattttacagtttcctttatgatttcttttttgatctatgggttatttaggagagggttgttttattgcccaatacataggggatttgctagatatcttattgtgaatgattttattctatcgtgttactctgtatgatttcattctttgatattcattaatacttttatatgatccagaatatggtctattttactgaatgttccatgacaactttaaaagaatgagttttctgcagctgttggatgtagtagtttaaaatattatgtcagtttggtttacagagttgttcaaatagtgtttactgaatctttgatctgcttgttctatcagttataagttgagcatccctaatttgaaaatctgaaatctggaatgctccaaaatctaaaactttttgagtgctcagagtaaatgctcattggatttggagcttcatattaggaatgctcaaccagtaagtataatgcaaatattccaaaatctggaaaaatccaaaatccttctggtctcaagcattctggataagggatgttcaacctgcaccaagagggtttacattctccaactatgattgtgaatttttttttatttctcctttcagttctgtcagtttttcctttgtgagttttggaaatgtgttgttaggtacatctatattcatgattgttttcttctcaattatcctttttttattattttgaggtattcttcttaatatccagtcatactctttgtttaaatgctacattgtctgatattaacatagtcataccagatttcttatttttggtgttttcatactgtatctttttctttccttttactttctattggcctgtatctttataataaaattgtgtttctcaaaaacaacctatagttgggtgttgcctttcatatccaatttactaagctctgactttttcttagaggagttagtccatttacatttaaggtaattattgatatgattcgacttatgtctcccatcttggtatttgttttatatttatggtatttattctttattcctttgttcatttttgtcttttcaggggaaaattaagtattcttaatattacttttatatcctctgtggatagttagattatatttcctttttaaaaaatttagtggttactatagaaactacatgtaaatgttcacagtataccttcaaacaatgtttaacctaattcacagtataaaaatcatgctgcagtataattccacttatgtccaatcctgccttttgtgctcttgttatattctgtgttacagtgacacatatggtattaatcctatcatacgttgttattatttccagtctacactgtaaatagtcacttaaatatttgagaaattataaatgtaaaaataaaagtcaaaaaaggtcttttccatttatacaaatatttaccttttctggtgtttttaattcctttctgcacatctggggttccatctgatataatttccctcagcctgaagtatcagcaagtatctcagattttgtctctctaaggatatctttatttcatcttcattttgaaggatattttttgctagacatagaattctctgcttccatttcttttttcttgtcatactcaatgatgtcatttaattgttttctggctttattctagattctgatgaaaagttagccatcataaatttttttctaatgtatttaatgtgtcattttattcctattgctttttagatttgctgtttattgttttatgtgatttttggttgttaaatagctaggtaaggttttctttatatttatcttgcttagggttcactgagcttcttggctctacaggtttatgtctttcatccattttggaatgttctcagatggttattattatatcaaatatattatctatccagtttttctcttctctttctggaacttctattacatcacttgatatcatgttagattcatttatactgtccaacagatcttgaatattctgttgtattttttccactatttttgccttttgtgtttcagtttggatactttctattgatctgccttttgtccctgatgctttcatctgttttttttccagtgtgctgttaagcacatctgatgttattgatttctaatattgtatttttcattgctacttatcccatttgattttcttctaacatttcctggtgaacatgtctttaggaaattttccatttcttcatgcatgttatctatatttttcgttaggcttttggcatttttattatagttattttaaattccctgtctaataattccaacatctgagtcatctgtggatctgtttttcttgattgtttctactcttaactataggccacttttttgttgttctttaaaaaaatattaatacgtcttctaatgtttgattgtatactgaaaattctgtataaaagaacagtagagactaaagtaaaaaatatttacatccaaaagagcatgcttttgataagacctgtagtaaatctctcctctcctctaaaatgatcttcactttgtggaatttagttcatttggatttttctgtgtccttagttcactgaaggttttcttttttccaaatagctttgtagctcatctaatttgttttgattatttgcatgagaatggcattttctgttgactttctatttctgaattcaaagtagtatgcaaccaaatatgcttcaacaaagatgtgcattcaccaaatatttttttaaaaatttacaataatttccttaacataaattctagaaggtagacattgatcaaaatatctaaagattttttatggttcttaataaaatatggtcatattacatctcaaaaaaacaaggaagttatacctatttttaatgagtgcaaataaccattttgcttcataagctttaagtgttataattaatttgactttgctaacttattcaaaaaatattatttcatattacatacctttaacttcaagcactgtacaggatcaaaatcttatgttcattttttagcaggactgactttacctggagaataagtgaacccattaaacatcagaattgtttgagtagatagatggtaatgactgatatttattgagtgctttttatgaaaaaagtggtgttttaattctcacagtgacctgtgaagaaggttatcatttcatcactccagaaggagggtttattccctacagaggagaaaagagaggctctgatataatgggacaggattaaattcaggagaatctgagccccaaacctcagtcttccaactttgatgtgatttaaatcatatctgaatgcaaccaatattgctatctgtattagtcagctgttgctacaataatgccatataacaaacaccccctaaactcacacttaaaacaatagttttgtattctcattgagctgcagtttggcagtagaagttttgctttaaaactcccctcttagtcatttattgaagaaaaacataatgaatacctcttattttccaagcactcttctgggctctggagaaacaacaatgaataaaatacacataaatgctgcccttaggaaacttactttcttgagggaagagacatacagtaaataagtagactatatagtaagtaagatgctgataatttctttattttgtttatttttctttttctaaattggtttcctcagattgaagataatttctttctttttttttttttgagacggagtctcgctctgtcgcccaggccggactgcggactgcagtgggcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgataatttatttcttttgtttttttttttgagacggagtctcgctcggtcgctagactggagtgcagtagcgcaatctcggctcactgtgacctctgcctcttgggttcaagcgattctcctgcctcagcctcctgagtagctgggactacaggtgcacacaccactacacccagctaatttttctatttttagtagagacaaggtttcatcatgttggccaggatggtcttgatctcttgaccttgtcatctgcccgccttggcctcccaaagtgctgggactacaggtgagagccacagtgctcggccagattaatttctaatgacagctataaagcagtggaagaggagaggacgggctgtcaggtgaagaacagcaacagggattgctgttgcaatgtgctttctcttatcactgcgcttcctagcataccgccaaaccctggcatctctgttcatttttacaatgcagagctatttcactacttctttgtttcactgtcttcttctaaactgtgccctggggggcctcacatttcataaccaaagctgcctatcaaagtgttttgctaaagaaaatatatttagtctggagagaaataatgtctctcccttagggacagaagcagctgcagtcagtagtagttttagatagcatttttctcctctgtcacgcagcattgcaatctcttctttatttaaaagttgaaggtcagaggtgaagatgtgtggaaacttactgaggaaaggagacatttgcagagcacccactatgtgctagatctggtgcaagcagatgtcttcaaataatccttgaattagacattatgattcccattttcctaatgcaaaaactgagctgtatgcaggcaaaataatccactctcggacacaaaaccagcagttgcagatctaagttttaattcttgagtgtgtccttccagcctcctcccaaccaccttcttgttgctttggattggatgtagagagctgcttattttataatctttgtggctagacctggaatgctggctttgtgtttctgggcctctctcccgcttcatggctagtctgtgtggtatagcccaactgctgccccagtaataggaggaggcagtcaggtctggggggaaatgaaagaattcccagggcacccggcaaatgaatgaattccactgatcttgtttggttccttatgggatcatccatcatgatttaacaacttgcagcccagggtaactacaggcatgcttcttgcccaaagccacagacacagtgtaattcatggctgaaaaacagatttgtttttctgttattattacctgtatcatgcccattatactatattatatgctgtgttatcatgtaatttagtcctctgtctgccgcattgacgtttgcttttgagaagactcggcttttctcattcttttgtaatgcactaaagtaaacaaattccctggctgtaatgtaagcagatatttgttgagggcccactgtgtgtacagtagatgggatacagaaaagctctggttttgctcaggaaacttaccctcctattgttttctgcatttaattttatttttaatttttttctgaggcagagtctcactctgttgcccaggctggagtgccctggcatgatctcggctcactgcaacctctgctgcctgggttcaggccattctcctgcctcagcctcctgaggagctgggattacgggcaccggccatcacacctggctaattttttttttttttttttgtatttttagtaaagacggagtttcgccatgttggccagcctggtcttgaactcctgacctcatgccatctacctgccttggcctcccaaagtactgggattacaggcgtgagccaccatgcctggcctatttttaaattttttaatgcaatatttgaaacacagaaataatatatatatataacatgtaagttatcaaacatatcaacaaaatgaagacccataaaatcattgctgtcttagtccatttgtgttgctataaaggaatacttgagactgggcactttattttaaaaagcagtttatttggtgtatggttctgcagtctgtacaagaagcctgacactgcatctgcttctggtggggcctcaagctgtttccacttagggcagaaggggaagtggagggactgtgcacagatgacgtggtgagagaggaagcgagagagagaggaggagatgccaggctcttttcagcaactagttctcctgggactaagaatgagaacttttttttttttgagacaggatatccctttgttgcccaggctggagggcagtggcatgatcttggctcactgcagcctccacctcccaggttcaagtgattcttgtgcctcagtctcctgagtagctgggactataggcgcctaccaccacgccctgctaatttttgtatttttagtggaggcagaggttcttcatgttggccaggctggtctggaactcctggtctcatgtgatcctcccgcctctgcctgccaaagtgctgggattacaggcatgatccactgcacccagcccaaaatgagaactcacttctttgagaatggcaacaagtcattcatgagcaatcaactcccatgccccaaacacctcccaataggtcccacctccaacatggggagagatttcaacacgatgtttggaggatcaaatatccaaactacattaagtgcctaactgattgactaaaatgaccagttctactggatccatctgggtggaaagtgcctcttgcatcccccatcctatccccatgtggaaatctacaatcctgttttgtgtttatcatcccctttctttgctttgttagctttaccacaaagctttatcagttttgcttgcttttgagctttataaagatggtctcataccttaaataatttttttttttttttgagacagagtcttgttctgttgcccaggctggagtgcagtggcacgatcttggctcaccgcaacctccacctcccaggtccaagtgattctcctgcctcagcctcctgagtagctgggattataggcatgtgccaccatgcctggctgatttttgtatttttagtagagacgaggtttcaccatgttggtcaggctggtctcgaactcctgaccttgtgatctgcctgccttggccacccaaagtgctgggattataggtgcgagtcactgtgcctggccttaaataatattttaagacttgctttgttcacactatatggtttctaagatttattccatttttcttcatgcttcttttctttcttttctttaaattgaggttttttgtttgtttttgttttgttttcaaactctgcttttccctttacttgttggaattttaaaattccaaattcaaatattaagattctaaaaattctaaaattccaaaaatttaaaacctcttttctatcatctctcccttgaaattttattgtgtgtatcaaggaaaattgaaagcccataaatatcttaacttccccttccaaatactgtaaggactttatgatactttaatgtcaatgacttccccattacttaaatgtcaatgttgtcagtagtttcaatctcatcttaaattctcacaaatcagattgttactattaatattttatatagataatgttttagatttatctcctagtttgtaagcttacttgctaactattcttcttacactcgaaatttttttttctgggctatttttttttttttttttttagtattcttttagtgggaatttatcggtggtaaaaatctctcagtttttgtttatatggaagtgtcatcatttcacactcattcttaaaagacacatttgcctgaagcgcaattctagaatgatggttgttttcttttagaattttggagatgttattccagagtcttttggcttctgttgctttgcctgaaaactcaggtgatgatctaaatgtagtgtttttgaaggttatctgcccctttcccctgtgagcttttaagtcttctctgtctttgatgttctgtggtttcactgcaatatgtctagctatgaatttctttgcattcatcttgcttatatatgctgtgcttggacctgaagattttatgtgtgtgtttgtgtatatgattatctatctatctatctatctatctatctatctatctatctcatcatgcctcacttaacaatcgggatatgttctgagaaatgagtcattaggtgatttcatcattgtgtgcatatcatagtgtccttatacaaacctagatagtgtagcctcctacacacctaggctatatggtatagcctatggctcctaggctacatgactgtacagcatgttactctactgaatactataggcagttggaacacaatggtaaacctttgtctgcctaaacatatctaaacatagaaaaggtccagtaaaaatacagtattacaattttgtggagccactgatgtatgcagtctgttgaccaaaatgttatgtggtacgtgactgtattttaccatttttacaacatttctttccccctcccctcccttcccctcccctcctctcctttctctctcggacagagtcttactctgtcatccaggctggagtgcaatgacgcagtcttggctcactgcaacctccgcctcctgggttcaagcgattctcctgcctcagcctcctgagtagctgggactacaggcatgtgccaccgtggccggctaatttttgtatttttagtagagacagggtttcaccatgttggccaggctggtctcaaacttctgacctcaggtgatctacccacttctgcctcccaaagtgctgggattacaggcatgagccaccctgcccagcctttgcaaaatttctatctattatcacttttaatattgcctcttatccagtctctctattctctcctaatattatgtctaatatattagacatacattagtctgtttctttctgtcctctgtatctcctaacttctctttaatagttttaatcacctaatctatttgtgttgttgcaccctagataatttctttagacatatcttcaatttctaattctctttcctgctatttttaatctgaattgagtttttattttatttttcttttttgttatatatatatttttgagacagattctcactctgtcacccaagctagagtgcagtggcacgatcctggctcactgcaacctccacctcctgggttcaagcgattcttgtgcctcagcctcctcagtagctgggattatagacctgcgtcaccaggcccagctaattgaattgagttttttacttcgacagttatatatttgatttccaaaatttttatttgaccatttttcaactatacctcataatttttttataaacgttgattattttcccatttttctaattccatcttttatttgtttaaatattttaatcagaattattttatattatgtatctgattatttcaatggttccaatatctgaagtttgtgggagtaaaaatttgttgtttattaattctgctgattctcactcatggtggcttatttcctaatgagtttggtggcttttgattataagctcacagaggcttgatcttaatctatggaaattcttatgacccaagtagaaaatgctttcacacagggagaattttcatttgcctccattaggagcctgggacaccaccagcattgtcttccttcaaaataactagccttacatgggagtctcagattccccaaccttgtcacagtcagtgactagttgttaatttaatcataatcacttgatgtatttttttaatgtcacacactgtccggtgtgttccacaaacattatttctaacttgcaaaataatcttgtaaaccacttcactgttgaggagataaaagctgggggaggccttccacacaatctgcttctcacaattctcctacacttctacaccatctctgcccatcaaaatccctcccctccttctacaccgtcctcaaatgctgcctcctcagggacactattcttgagccacaaagctgagcttaggcttttgctcctgtttatttgtttgttttttgagacagagtctcactctgtcacccaggctggagtgcattggtgtgatctcacgtcactgcaacctccgcctcccaggttcaagtgattctcctgcctcaacctccctcccaagtagctgggattacaggtgcctgccaccacacctggctaactttttttgtattttcagtagagatggggtttcactatgttggccaggctggtctcaaacccctgacctcaggtgatccgtctgccttggcctcccaaagtgctgggattacaggcgtgagccaccgtttgttcctagaacacataatttatatcggtgattcaagtaatcatcccatttcacagatgaagcatttgaggccctggagtttcatttgtaggcatttgtgcggatctacctaaaatgtcatctggctgcaaggccatcgcttcagtgttatttttgcatttatccttctccatccctcctaggcaacccctagttccttaccttcctcatatacatacagaatgcaagactaagaggaaggattccaaaaagttggatacattaaatttaggtggagagatgaggaacatatggagaacaggccatcagcttagtgattgtcaggcgattcctgtcatcaatatgtacccccgtggcccatgttaagtcccttactcattgggactgccctggtcctccgttgacctcaggtaaacaatcatttaagtgggattttattcaaaaattgcacttagagtggttttagtgggtcacattggctcttccatgaattctttgcgtctttttaagccagatctttggcattttatcaatctttgctttggcatcacgtttgaggatatattcaggggattttttttatttttaaaaaaactcttttgtttattgacagaaatagcatttctactaatacctcaagagcaagtactatcatgaatttaaattatttttccccaaatttaatcaagagtacttgagttaccagcttccaggttggccagaagtcctgaattaccttattgagactttctgctccagttccagggttcttgtataattaggagtcctcacaacttgtactcccaattagggaaaagcgctggtatttgtcagcctgtttgggtttcctactgagagaagatggcactgttgaacacggagccagtgctgctgggctacaatgtagtgcgggctggtaactctcacggtaacccctcttagaggtcctgttctggatgaggtttgtttatccactcaccacggtccccacaactccaatgccttttccaatgacagcaggtgaatgagacctacccaggatcaggccatttttactttcagcccctgagagagaaaagaaattaatttggttctcttttctgaacaatagagatttattcgttctaaaaattctacaaaccatatccagcaggcaaagaatgcctggactttagataaaccaaaagggcagtcatcctttgtggcagagtgctaatttttctccagtatttattttctccttcattttgttagcagtagaacttctcaagctttcactctgtatgtgaccatctgggtagagactacctttcttagcttctcttgcaactgtgtgtggacacgcaactaaattactgcctccagggtgtgagcagaacggatgcgtgcagcttcaagtcacagcactggaaaggaaaatacttgcctttcattctctatttcctctttctacacgttggaatttgacggagttctggcaagtctacttcaaccatgtggatgaggacaatacttcagaggaaagaagaacattaaaatgcaaggaaccagatccctagatgactgattgcaaggggcaaagaaactatggcagccctagactatgtacctctggaccaatctgtgaaagagaagtagattcctacttggcctgagtcactgtgtttttggatctcttgtaccagcaactcagccagtgtcctaaataacatgcatcctccctagtgggactggagagcttataggttcagtctcactgatgatccaacctctttagagcaggcaagaggaatttcatgtacctcttgataaagcggtaagcaaaacacaaattcagtgggacactccactgcaggtgattttgaggttctgcagtctgtctatcaagttaaatgagaaaaaagaagatagaggatcctggctgcataatcacacatgcacggaaggcaaaatcatttggacgggagccttgagtggtggagaaagcaagggctctgagccagatatttcagagttcacatcagtgtgtctttataatttagttgtttaagtcactactttctcatctgcaaaatgggaattgcaatgcatatttcatgtacttgttccaggaactaaatgagataatctatttaaaggtcctggcacagggtctggtaaaaattaggtgttaagtgaaagtaagttcccttccaatgtctgggcttttgatcattgcaccaagctgcctctgcaaggcacacaagactctaggtgatctgattcctccctttttcaccccttcagcttcatctggggccacttttcccttgcccatgactctctgactcctaagcccatgactagtttcccttcagtaccaaagccattctaaattctctcctgcctctggatcttcatacttccttttccttctgcttgcaaccctttctcatgatcacatttcagagaagccctcctgaggaccacgctatctaaagtagtttcttgtccactgtgttcagcagaataatgacaccccgcaaagatgtggtttttatgaagacagaaacatctgtcttatttaccagctcacctgctacagtatggattatgtagcacatactcaatatttattgaatgcatatatgaatgaaaaattgaatgggaactttgaaattcatcctcatccctggaacccaagagtatgttaagtgacatggcaaagggcaattaaggcagcaggcgaaattaagtttactaatcagctgaccttagggagctattcctggaatatctggttggacccaaaggaatcataaagatctttaaaagtggaagagaggggcagaatcgaagagtcaaaggtaggagtgtgatgacggaaacaggtatgttactgcccttgaagatggaggaaggggccacaagccaaagaaagcaggcagcctttagaagctggaaaaagcaagaaaatggatgttctctagagcttccagaaggagcagccctgctgacatcttgatctttgcccagtgccttgatttcagctcagtaattttagcccatgttggacttctgaagtacagaactgtaagataatacgtttgtattgttttaagccactaaatttgtggtaacttgttccagcaacaataagaaactaatatacctgtatgccagcccagtatctaatatatatatatcgccctctttatttgctgcctaacactcagcacgatctgcaattatcttatccatttatgtgtcctcttgacttagtcaaatggggcttttatgaagacacaaatgtctatcttatttaccagctcacctgctagagtacgggttatgtagcacatactccttctttattcatttattaattatactttaagttctggggtacgtgtgcagaacgtgcaggtttgttacgtaggtatatacgtgccatggtggtttgctgcacctatcaaccacactaagtatttctcctaatgctctccctcccctagccccccaccccaccaacaggccctggtgtgtgatgttcccctccctgtgtccatgtgttctcattgttcagttcccacttgtgagtgagaacatgtggtatttggtcttctgtgcttgtgttagtttgttgagaatgatggtttccagcttcatccatgtccctgcaaaggacatgaattcctccatttttatagctgcatagtattccatagtgtatatgtgtcacatttctttatccagtctatcactgatgggcatttgggttggttccaagtctttactgttgtgaccagtgccgcaataaacatacatgggcgtgtgtctttatagtagaatgactccatatttttttaatgcatgcatgaatgaaaaattgaatggaaactttgacattcattttcttcatctgcagggcttgtttctgagagtgtgcacggagattgaagggcaggggctcatgtgacagtgtgaagcaggaattctgaccgttggccaaaccaagccctgaaactcaagttctgtttgggagtgagaggcaggttagaggagataaacacccagccttttaattttttttttccagcctgctttaaatcacctgtaaatctttagtggccaccaggaggtgaatgactcatgctaccttttctcagcaaaggctcttcaggatgggacactccaagtttttaactcccagcaacagttcggctcacagcgagaccgggccctctgctgtcactgaagtgtgtgtttgtttaattagggcgccgagtagagcctcatcctggtggcagatgttgccatgtgtagtataataaataaaagtctttataggacccagcaggcagtagagccttcagttagcagatggcgaaatattaaactggcagagcaataacttaactgcctgaatcagctggtccctgcccggatttgctccaacatgaatcaacttcatataggaggtgtcgctcagcctcagatgtgtaccctcacctgccctcgctcctggtccctgctaggaccatgtttgccttggcataccactattaaagtcagattactgggtttaataccattattaaagtcagatacataagtttttttataaccttattagctggtcaaagagaggtgcttgctgggctggaccgtagggttcttttacaggggaaggaaatgcagtaagcctgtggatgtcctctgtgccagtttctgcttggctccagattagccagacagtatgttacctggcccctgggccctcgtggtgcaggagaaggatcccacttggctccaggaatcctcctgtttaagaccaggaggatggttcagttagcccagggagaccccactggaggagagaacagggctttttgttctgaaaagacccaaaaaagggattgactgacatctattacattgctgcaggggtggagtgaggggcattggacttgtttactaaattccagattatacgactgatatttacagagggcttgctatgtgttgggactttggataagggctttgcagacgaacagaaacccaccccatctttaccataaccctgtgaggcagtaacaacgaacccttctagcgctgtgtgccaggccccgttccaagagcttaatgtacattgactcactcaactccccaacatgaaacattaaacccatttctcacatggggaagctgaggctctgagaggtgtgatgatttgttcaaaaacacacagctagaagataccggagctaagatgcaacccaattgtgtctaaactcagaggcggcagttgcctttgactccaggaggcataaaagtaaacttggacagaagatggtgaacccgtaggcaaaatgccacctagaaaatgaagtggggaactgatactaggaaagaggatataaaatttatatttgttgccatttattgccataaattcggctactttttaacagatatctgaaataattttctcctttaattcttacagaaagccttggaggcagcttcaattagaagctaattttactaattagaaaattggtatcagaaggacgattgaacgtgtccaaggtcacacagccagtaaggagaggggcctggactggagcagacctgtctgattcactcagacaggactggagcagacccttgctttgttcactcaatagttttttccaaaggctttttaagaagaggactttggagttgtaaagaatttagatacgtggaaatgagagaaaggccttccaggcagaggaaacaggatgaacaaagtcttggcaggtatggacaactctgtgtgtgtgtgtgtgtgtgtgtgtgtgtgtgtgtaggtaggtaggttggttgttggagacagacccagggaagccttgaatggcatgctgaaagaattggtctttctgcccgggcttggtggctcatgcctgtaatcccagcactttgggaggccgaggcaggcagatcacttgaggtcaggagttcgagaccagcctggccaacatggtgaaatcctgtctgtactaaaattacaaaaatatcagcccagcatggtggtgcagggttgcattctcagctactcgtgaggctgaggcaggagaattgcttgaaccccggaggcagaggttgcagtgagcagagatcatgccactgtactccagcctgggcaatagagggagactccatttcaaaaaaaaaaaaaaaaaaaaaaaggtgcttctttctctggcaaaggaggatgctcaagttttctaagtcaataattaagctcatgcaaacaaagggccctttctgatcaccatggtgggtttccactgcctgcttctccgctaacttctataacgaaaatgatactcaagacttttcttgccatcatggtcaataatgtgagggtttgagcacatcctcagagttaggctttggaatttcttgaattcctgctgtgtggggcgtgctggggagtctttggtctgagggctggctgctgctcgctttggccctttgatctcccagtgcccgggatctttcagtctagcttttcctgtgtcctgcattgccagtccccccaccctctggatctgtcccctttttgttgtctctgagctaatgggacagattccatggatgctggcctggacctctctttcttcagcctgtctcatgacctctaaggcctggcctgaggaggaggcataactctaggaggtcgaggtgagcctggcgctgcaagtatgcccctaatttgtgaaaccacagtcatagatatcacagttggttaatacactcgtccttggattctttcaaattcattgctcctgttcaaaaaacatttctctttttttcttattgcagtagtaatacatgcttattgtatgttatgaagaagatgcagaaaaatataagtgatgaaacgatagcccataataatcccacaaccccaagacaatcattattaaccttgggtatattttcttacagtcattcatacagacgtatacaaaacacacgtctgtctatatgaaatacttacgtgcttaaactcataccagatatatgattttgcattccatgtttccactcttataaaatcagtgcaatttttttacattgctaaacttctttgtaaaaatttatatagaaaaacactgtaggccaggcacggtggctcatgcctgtaatcctagcactttgggaggctgaggcgggtggatcacctgaggtcaggagatcgagaccatcttggccaacatggtgaaaccctgtctctactaaaatatgaaaaattagccgggcatggtggcacttgcctgtaattctagctacttgggaggctgaggcaggggaattgcttgaacccgggaggtgaaggttgcagtgagctgagatcacaccactgcactccagtctggtgacagagcaagactccatctcaaaacaaacaaaacaccataaaacaatattaaagggaaaaaagcagaatttgaattcatatgtttaatataatttcaattatgttagctaaaaacacatgggtacacgatgcctatgcactacaaaagtaccacacaggatggaagcagagactacaaaatattaatagaggttatctctaggggatgtgttttattttattcttgcatctttccatgttttccacgtttttcccacatattaatcatgaatttttctaatgagaaaattttgcatagctacataatagtccaagatatgaatataccattgtttatttaattattggcctactaaaggcctttgggtagtttcaaagcttttacatttataaataatgttgtgttaaatgttcctttatctgttcaacagatatttgagagtctatggcatgccttgtatcttggtgcctatatctgcatatgttatataaataatattttatttttgtggaaactgaagagcaaagaaatcaccgagttagttggggacacggatgggtctgtgcttttaggtctttcaattctgaggatttatctttgccagactgctttcctcaaacctctggtctccctttggcagaatggtggcaaattggaggttctcttgggtatattgagtcacagatctccttgaatagtgtgtgacactactcaagaagtacctacttggcccccagcctattgcctggtggcctccttcttgcagatgcacccattttgcagatgggtcaaagcatgtagtcttacagcacaaatacttgtctttgtggaaagtcatcctccctctgcttggctgctagactttcctgtgtgtccatcataggtgtggctttgtggcacccagtcaatctgattaagatggttcttgcttatcagcttggtgctatttgagatgatacattggaagtccacctcaaatatcacctcctccctgaaattatccagatactctcagacaaagttcacagctcttttttggatttttttttttttgtgtgtgtgtatggccttattttaaaaacatatctctccaaaccatggctgtgtctgtacatctttttctcatcaagtaggttattagctctttaaggtcagggaccacatgttatccactttggtaccctgtccatttgcttctgtttctcagtctagcgcttgccttcatctccactgccactattcaagtgcacaccttctatcaccacccacctagaacactgaaccagtgtccgacctgctgggactccctgcatctgctctcgtgccacttacaatccagttttcccatagcagtgaaagggattatttgaaatcacaaatcaaatgtgccatttctttccgtagctcagcaagatctggccctcgcctgcctctctgacatcatcccagtgaactcatccccattcctcacagcacttctctctgatcccttttatcacatcattctgcataacagtttggattattgcccagcaagtgttgatggcctccccgctccaattgtggatggtatttacttccctaccacatgattttgggcttggccatatgactcgttttggccaacaggatattagtgggtagaagtgaacagagatttgaaatgtgatagagtggttgggctcacctactttagttcttccatggccatgagggtaacatgccctgggtaacctgttggtcccagaagagtgagagatgcaaggaacagacatgaactaaacatatggcctggagccaagcccagcctagatcagccaaacccaggacaaaccatagttgcataaatgaggtacacatgcttgctgttgtggagttactggctgtatgctacccagcactgctgtggcatagttgactaacacaccctattttatgcacttcataattattattttgaactttccgtcttttctaatcaggacatagtttctatgataaaagagacattgcctattttgctctataattccagctatatatatgaaatcaccaataaatatgcatgtatgtgtgtatgtatgtatgtatttttgagacggagtcttgctctgtcgcccagtgacgcgatctcggctcactgcaacctctgcctcctgagttcaagtgattctcctgcttcagcctcccaagtagctgggactataggcacgtgcacctttttttatttttgtatgcctggctactttttgtatttttagtagaaatggggtttccccatgttagccaggttggtcttgatctcctgaccacgtgatctgccagccttggcctcccaaagtgctgggattacaggtgtgagccactgtgcctggcctgccaataaatatttattaaatgactgaatacccccggcatgcttagcacaatacctgtgcccgatcaatatttgctgaatgcagttggtgaaccatccaaagcagcctgtattgtgtcctaacatgtatatctttaaactcaacttggcacgtgggtgacacctctatcccctctcttcctctctctgatcacataaaagatcctccttgtaagaatacacacactgaaaacagatgatgtgtcaatgccgtaatttaaaccatgaatctgtacttgcttaaagatgaacttgtttggaagaaaaatgaggaaaatgcttgtgcccgtccaacagagtccccggataagtacatcaattttgcttcttagcggatccagcacataataaaagaaaactgctgaggtcagcagcagcagagaagccacacttcttattttcacaaacacagttttggggatggtaatcatatctattagcaagggtgacaccactgtgggcctggcagaaaaatgagctctcccgcattgcaaaatgagcaaagtggagatcgataaatcataaaattagttgagacatcatctatctttcatggctttccctttattcctgccacggtccctcaggacactcattcatttactgcattttattgttgggaaaacacgtcaaggtttggaggctgcattcagttaggggagcaggggccataatgtgtgtcattaattaggcaggtttgggaggttcaatccaaagtctggtctcaactgacttccataaattgagttttaggactgcttctgcgtcttgtgtgacttcatcaaaaagagaacgttattgaaatatgccctgagagggagagagagagaaagagggacatgtctgctcactctgtagaaacgataaatttagggacaaaccaggtgataagccagatgcaatctgagttgtctaaagattcttgctgttatctacatgtgattgaaataaatgtgagacacagagcttggagtgcatagatacgtcatctggtacctatattcttcatgtcaaggcatatagtaaacagattttttttcaaaaaattattgtgataacacttaacatgagacgtaccctcttaacaaattttaagtgcacaataccttgttgactctaggtacataatgtgcagcagagctctagaacgcattcatcttgcctgacggaaacttcacgcccattgatgagtagctcctcattttctcctccccacagccctggcaaccaccattacactcttttgttctacgcatttgactatttcacatgacccctgtaagtggaaataagaaatatttgtctttgtttgacagatatttaacttaccataaagtcctcaagatttaattcttgttctcacatcttgcagaattttctcctcctgctcctcctccccctcccacctcccccctccctcccttcccccccacttctcctcctcctcctcctcctccttctccttcttcctcttgttctgatggagtttcactcttgttgcccaggctgtagggcaacggtgcgatctctgctcaccgcaacctccgcctcctgcgttcaagcaattctcctgcctcagcctcccgagtagctgggattacaggcatgtgccaccatgcctggctaattttgtatttttagtagagatgggatttctccatgttggtcaggctggtcttgaactcctgacctcaggtgatccacccgccttggcctcccaaagtgctgggattacaggcgtgagccactgtgcccatcccaaattttattctttttgaaggctgaataatattccattgcgtgtatataccacattttctttacccattaatctgtcatttaggttttttccccattttggctgttgtgaacagtgctgcaatgaacatgttagtgctaatatttcttccacattctgattttaatttttatgggtataaatccagaagtaggattgctggatcatatgctagttctattttcaattttttgagaaacctccgtactgtttttcttagtggttgtaccattttgcattgccaataatagtgtgcaaaggtttcaatttttctacatcttcaccaacatttgttgtcttttgtctttttgacactagccaatctgacaggtgtgaggtgatttctcattgtggttttgatttgcaattagtgatactgattatttgtggtattggacattttttcataaacttgttggcttaactaaggaggtgaaagacttgtatactaaaaattataaaaccttgaaagaaacgaaagaaggtggcccggcatggtggctcatgcctgtaatcccagcactttgggaggctgaggtgggtggatcatgaggtcaggagtttgagaccattctggctaacatggtgaaaacccatctgtactaaaataaaaaaaattagccaggcatcatggtgcgtgcatgtagtcctagctactcgggaggctgaggcagaggaatcgcttgaatctgggaggcggaggttgcagtgagccaagatcacaccactgtattccagcctggtgacagagcgagcctttgtctcaaaagaaaaaaaaaaaaaaaagaaatgaaagaaggtataaacaaatggaaagacattccaaattcatggattggaagacttcatattgttcaagtgtccatactatgcaaagcaatatgcagattcaatgcaatccctattaaaatccaaaaggcatttttcacagaaatagaaaaaatgagtctaaaatttgtatagaaccacaaaaggccacaaatagccaaatcaaccttgagaaagaagaacagtgttggaagcatcacacttcctgatttcaaaatatattacaaggccacagtaattaaaactggtataaaataaaatatggtactggcataaagacagacatataggccaaaggaatacaatagcaagtccagaagtaaatctacacatatgtgatcaaatgatcttcaacaatggtgccaagaatatgtaataggggaatgattgtctctttaataagtgatgctgggaaaactggataaccacatgcaaaagaatgaaataggatccttatctaacaccatacatgaaaatcaactaaaaaaggactaaagacttacaagtaaaacctgaaactgtaaaactcctagaagaaaacataggggaaacacttcatgatgttggtcttgccaatgatttcgtgaatatgacaccaaaagcacagacaacaacaacaaaaataaatgatgagaactatgtaaaacgaaaaagtgtctgcacagcaaatgaaacaatcgagttaaaagacaacccacaaaatgggaaaaattatttgtagaccatctatgtaatgagttaatttctaaaatatataaggaatttctacaactcaatagcaaaaaaaaaaaaaaacctctaacaatctgattaaaaagtgggctaaggactttaatagacatttctctaaagaagatattaagtaggtttctaaaatcgtgatgtgtttttcatttgatgtgtgcatttaattgacgctcattactccatcaaaagcatcctgaaatcaaggaaacagtacttactagaatgtttcagtgatcgatttctgcctattaaaccaccccaaaacttaatgcattaagactaatttattattgctgtgattctgggacaaaacataactaactttttattcccctttcaaggtgtattttctgcagaacccccatctcagtaaatgccactatcatccactcccttgctcagctccttaaacttggagtcatccttgacatttttctttctctcatgcccctcatctagtttatccacaaattaccaagaaacacccacaagcctcctctcttcagcactacccccgtaatccaagccaccatcccatctcccttgggctattctggtagcctttataatcggtctcctgctttacctcttgccttattcagtctattcttcatatagaaaccagaatgatctttaaaataaatataatcagaggatgtcaacctccccaccacccggaccccacagcttatgactatccagcagctacctgttgtattcagaataagacccttataaaaccacttgctatagtctacaaaggccctgccctcctctcctcccttagctcatctctagccacactggccacactggccttccttctcccctttagcatgcatggacgtttacaccccagggcctttgcacctaatgtatgtgtgtgtgtatatatatatatatatatatatgtatatttgttgttgagaggaagtctcgctctgtcacccaggctggtgtgcagtggcgggatctcggctcactgcatgctccgccacccgggttcacaccattctcctgcctcagcctcccgagtagctgggactacgggctcctgcccccatgcccggctaatttttttgtatttttttagtagagatggggtttcaccgtgttagccaagatcgtctcgatctcctgacttcgtgatccgcccacctcggcctcccaaagtgctgggattacaggcgtgagccacccccacatccgcacctagggttcacaccgaaaaaaaatagtaggctctggagatgcaacagaccctgctttcattggagctttcagagagggaagacaagtgaacacatgaataaatgttaagaggtagtgagcattaaggagataaagtaggtatagagaatggagagagatgggaggtgtgaccccgtttcaatagggtggtgagtgaaggcctctctgaaaaggtggctttgagcaaacgcccaaataaatggaggggctgagccgtgcaggtatctggaagcaaatggggcaggggaaggagctgtttcaaaggatccaagatgggcaaatacctgcagggcttagaaatggtggctataatctgaaagcatgtagcaatagaagccttgcagctgaatacatgcatttgaggcagcaatgacttctttctagggggtttatgtgaggagggatttttctttttgggaaaaaccctgaggtacacgtattcaaaggaaatatttgttgacttggatggaaagggcctgtcttcagctttcgttctgctctgcctggctgcctctcagtgttaggttcaatgcttgaggctgtgccaagttgatttccctgtgagagcagacgcctgatagtagggcacagtgccagtcccgttgataatgaaatctttgcatccccgttgacacttctataaaggacagaagaggaactgtaagttcccattctgatcttttatttctgttttgtcaccctcaagaatacctgtcagaaagcttttgggatctggactcagatggacctgaatttgaagcccactgtgaattttactgcagtgggattttggtgagagctgctcaaacctgaacttgaggccaggcctggtggttcatgcctgtaatctcagcactttgggaggccgagacaggaggatcatttgaactcaggagttcaaggccaggctgggcaacatagggagatcctgtctgtaataaagaataaaaaattaaaaccctgaatttgagaggagcacgtggtgacagtgctcagatttgggttattcatgcccaatattgtggctctttctgtttttgttttcaaattttgttttatatttgtctttacagaacattaacattgttccaaactaataactaaataaaaaagccatcctcagagtaggtacagagtggttagttgccctggttggaggagtgggagagttctatcaccaatattgtttagaattgccagtaataataaaaatggatgacctttaattgctttttgttcatgtcataatactcgtgtatgaaattcatatatttttagaaataaccacgttgttttggaataattttagatttgcagaagttgcaaaaatagcacagataattcctatagttacccttcatccagttccccctaatgttagcatcttacatcaccatggtacatttgtcaaaagaaattaatattaatataacactattaactatagactttactcaaatttcatcagtttttccaccaatgtccttttttcctggatccaaaatttgatttagataccaaattgcatttaatagttgattgtattactgttttttaaattctctacagacaaggcacctattgactgcacctggcagaacaaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatgtgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcaacatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggcgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgataggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgctgttgctaggcagagaccccggagtggggagagggtgatagcatctggatcatccattcctacctaggtggttttggctcatagtaaaagggacctcagcacctatccgctgctcagcctcggagctgcaggtgtcagggatatcatgcactgtccaaaaagacatgcaaaacttaacacccgtgcattttcatggagagaccccgtggagcctctgaccagaggctgaaagaaatgtgtcattcaaaagaccagggaaccactgccaaggacccctacattcagcaacacatctatactcgtgcctgccacgtgtccgcacttagaggccattgtctcacctcagggtcaggagtgccaggtgaaagagcacacaggtctctgggcaaggcagagtttgaagctaggtctggaccaacgtctgagagtatgacttcaccccaggcgaggaagttcactttgagctcctggccagggagaaagcaagctctgggagacctaaactctgaatctcacttggcttttcagtctaatccgttgttgccaaagacatacttggcaatcccgaatcctcagagggctccatacgtgctgcgcttcagccttcgctcacggttcatcccacctggaatgcctttttctctccaaagatgttcccaagagccaagttaaatgtcacttccatttatcttcctccaaaaggaacatgtgttttacttcatctttctcctaaaaatgtggatgccttaatgagactaataatggttgttagtgcttgccaggcgtggagctaagagtgttacatatattatttaatctgagcaatcctgcatcatgggtactattaccagctccagtttttttgagacggagtccgttttgtcgcccaggctggagtgcagtggcatgagttcaagcgattcttatgctccagccttctgagtggctgggactaccagcacacatcaccacgcccggctaattttttttgtattttagtagagacagggtttcgccgtgttggccaggctggtcttgaactcccgtcctcaggtgacctgcccgcctcagcctcccaaagtcctggaattacaggcgtgagccactgcgcctggcccagctccagttgttcaggtgaaaaagatgaggcacagaattggaaagccatttgtccaagaggctaagaagtggtcacgtgagcatttaaatgtttttaagcctcagcctactcctctccaggcccttagcgtgtttcgtcctgcgttttcctggtctttcccagtgtttattagatgtctatagtgtccagacaatgttaggcagacgggacacaagggtgcacaaacaaacagtctgtgcccttattggaacctgttaatccctaaagggctaagcctccctacagcaagaaccctgttagtcacctgtgtatccccagcatctcgactctccacgggcatggcactatgctgtaaaaaaaataatccctgaccctcatggctatgggaaagcatgccttttaaagcataatccggctgggtgtggtggctcacgcctgtaaccccagcactttgggaggccgaggcaggtggatcacctgaggtcaggagtttgagactagcctggccaacatggtgaaaccccgtctttactaaaaatacaaaaatttgctgggcgtggtggcaggtgcctgtaatcccagctactcaggaggctgaggcaagagaaccgcttgaagcctggaggcagaggttgcagtgagctgagattgcgccattgcactccagcctgggtgacgagtgaaactccgtctaaaaaaaaaaaaaaaaaaaggataatccaatctaggtgcctctgcctcagtgttgcattcacagaattccgtggacccaaaaatcagtcttggaataggctgggatatggacaggacacccaggttctgcccctacacctatcccccacctggcttttttttttcttttccttgagacagtctggccctgtgagctgaggttgcaccactgcactccagcctgggcagcagagcaagactccatctctcaaaaaaacaaaaaacaaaaaaacaaaatggggttaagagaatgggctttggaatctagtggcttcactggttgcttgctgtgtgatctcgggccacttgctgtgcctctgtgcgtcagtttccttgtctttagtagagagatgatagtaacatttcctgtagtggttgtgaagattatacataatgtttgtaacctgctggagtggtcattagagctgttcaccaaatattcagattctccccggttggcacatggtgggagtgccttgtccatgtgactaactggccagtcagctgggagcagaagtgcctccttcaggcgggggcctttagtggctggcaggagacctctatggctcctctttcttttttttttttttaattaattttttttattatactttaagttttagggtacatgtgcacaacgtgcaggttcgttacatatgtatacatgtgccatgttggtgtgctgcacccagtaactcgtcatttacattaggtatatctccaaatgctatccctcccccctccccccaccccacaacattccccagagtgtgatgttccccttcctgtgtccatgtgttctcattgttcagttcccacctacaagtgagaacatgcggtgtttggttttttgtctttgcgatagtttactgagaatgatggtttccagcttcatccatgtccctacaaaggacatgaactcatccttttttatggctgcatagaattccatggtgtatatatgccacattttcttaatccagtctatcattgatggacatttggcttggttccaagtctttgctattgtgagtggtgccacaataaacatatgtgtgtatgtgtatttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgatggccattctaactggtgtgagatggtatctcattgtggttttgatttgcatttctctgatggccagtgatgatgagcatttttttcgtgtatcttttggctgcataaatgtcttcttttgagaagtgtctgttcatatcctttgcccacttttcgatggggttgtttgtttttttcttgtaaatttgtttgagttcattgtagattctggatattagccctttgtcagatgagtagattgcaaaaattttctcccattctgtaggttgcctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattaccaagtcaatcctaagccaaaagaacaaagctggaggcatcatgctgcctgacttcaaactgtactacaaggctacagtcaccaaaacagcatggtactgggaccaaaacagagatacagaccaatggaacagaacagagccctcagaaataatgccgcatatctacaaccatctgatctttgacaaacctgatgaaaacaagaaatggggaaaggattccctatttaatacatggtgctgggaaaactggttagccatgtgtagaaagctgaaactggatcccttctttacaccttacacaaaaattaattcaagatggattaaagacttaaatgttagacctgaaaccataaaaaccctagaagaaaacctaggcattaccattcaggacatagggatgggcaaggatttcatgtctaaaacaccaaaagcaatggcaacaaaagccaaaattgacaaatgggatctaattaaactaaagagcttctgcacagcaaaagaaactaccatcagagtggatatggctcctctttctttctgccatggtgatgggcgattatgcccaggagcggctgcttcatttgcctggcacaggagtgagggtgacaatgcagagatccagccacccagcaatgggtgtgtagcagcaagaaatgacccttttgtgaattaagcaactgcaatttggcgtttttataacctaacgtatcttgactgatacaaatgcttagagcaacctctgatatttagtaagggcttattcagtggcagaatagaaaagaatgggatctagagtaataaaagggattagccttctctttgtcagttagggatgtcaagagattatctgtagcaccctctgctgtcaacatgcctgtcttccatgaccagcctgtacccccctccctccacatgtttttgtttttcccagacagggtctcactctgtcacccaggctggagtgcaaatcgacctcctgggttcaagcgatcctcctgcctcactctccctagtagccgggactacaggcatgtaccaccatgcctaattttttattttttgtggagatgggacctcactattttgcctaggctggtctcaaactcctgggctcaagcaattctcctgcctctaccttccaaagtgctgggattataggtgtgagccattgtgcccagccacatggttcttcaatactcacccccaccccaaaccctctgacacatgcgtttagtcctggggtggggcacctgactcaacccaggttgaagatactttaggatattttgaacctgggagatgtgagggttgtctctttaaaatggtggaaattatgagatatttgggaacggcactactgatcctcctaatttatttttaattttttttttaggccgaggcgggtggatcacctgaggtcaagagttcgagactagcctggccaatatggtgaaaccttgtctgtactaaaactacaaaaattagcagggtggggtggcaggcgcctgtaatccgagctactcaggagactgggactacaggtgctcaccaccgcgcttggctaatttttgtatttttacaaagctttaaataaaaattgcttaaagctgaaaattgggtgggcgcagtggctcacgcctataatcctaccactttgggaggctgaggtggacagatcacttgagcccaggagttcgagatcagcttgggcaacgtgatgaaatacgatctctacaaaaaatacaaaaattagccaagcatagaggtacacacctgtagtcccagatactccactgaggtgggaggatcacctgagccgggggaggttgagggtgcagtgaggtgcgatcgcgccaatgcactccagcctgggtgacagagtgagatactgtctcaaaaaacataaaaataaaaaataaaagctgaaaaatttatatttaatattttgaaaacttaaatcttattgcatattattattaaataactttccagttctagtgttcaatgtcagtctaattgctcatctaaaggactgatattgcaacatacattttgtgtctcgatcttatatacaaattagagagtgatacaaattgtttaaatggctaaatgttcctcagctacagtgagtagccatattggtctcttttaaaaatttttattatttttatttaaacaaagttttaatttttttttgtagagacagggtctcattatgttgcccaggctggtcagccacaagtgatccttctgcctcagtctcccaaagttctgggattataggcatgaactaacacgcctgacccagattactctctaactcatgagtatgtctggaggcgcaatttggaacatgaagagaaacagaaaaatggactctcagtacttctgagaaatgatacttgttatacaagaatctactgcattcagcctccctgagaagaggaatttaagaattaatttctgcttcctcttacttaagtgtttcaacactcaagtcctttgcatactctgaagcaatgtgtgtctccaacattgggagcagctgcaacccacaaaccttcttgacataaaatagttgcattcattcattcatttatttgctctgccgcacaggctggaatggcagtggtacgatcttagcttaccgcaacctccacctccctggttcaagccattctcctgcctcagcttcccgagtagctgggattacaggtgcgcaccaccatgcccggctaatttttgtattttttagtagagacggggtttcaccatgttggccaggctggtctcaaactcctgacctcaactgatctgcctgcctcggcctcccaaagtgctgggattacaggcgtgagccaccacacctggccatagttgccttttgttttgagattttaggacaagagatgaatatgtttttttttttttttttttgagtcagagctttgctcttgttgcccaggctgcagtgcaatggcatgatctcgactcactgcaacctctgcttcccgggttcaagcaattcttctgcctcagcctcccgagtagctgggattacaggcatgcgccaccatgcccggttaattttgtatttttagtaaagatagggtttctccatgttggtcaggctggtctcgaactcccaacctcaggtgatctccctgcctcagcctccgaaagtgctgggataacaggcatgagccaccacgccgggcagaaatgagacatactttggggcctgaacagtgtttgttatgaaatggatgtttagggctgcagattgtgctgagccagtactgaacataagatcctgagtggacaggaacacctttgtggtcattagtgaatctgtttttaagagctgggagtggtggctaacacctgtaatcccagcattgtgggaggctagggtgggatgatcacttgaggccggagtttgagagcagcctgggtaacaaaacaagactctgtctctacaaaaaaggaaaaaattagctgggtgtggtggcatgagtctatagtcccagctactcaggaggctgaggtgggaggatcgcttgagcctaggaggtcaaggctgtagtgagttatgtttgtgccactgcactccagcctatttgagacagataatgtgtctcaaaaaaaaaaaaaagaaaaaaaaagaaaaaaaactcttggccgggtgcggtggctcacgactgtaatcccagcgctttgggaggccgaggcagctggatcacctgaggtcaggagtttgagaccagcctggccaacattggtgaaaccccttctctattaaaaatacaaaaatttgctgggcctggtggcacgcgcctgtaatcccagctactctggaggctgtgggaggagaatcacttgaagccgggaggcagaggttgcagtgagccgagatggcgccactgtacacactccagcctgagcaataagagcaaaactccatctcaaaaaaaaaaaaaaaaaaaagaaaagaaaagaataaaagaaaaatccattgaaaaaatcatacatttgtgagatggagagccaatcttgctaggaactgagggggttactggctgcaagggagatggggaaaacaagtcctggcctccacctaggggatctatagactcacagtgcaggaatttccccggagacagaggagcgctttaaaggtactgtgcggcccaaaatggtggagtagggaattccagggctccatccctcccccaacacaactaataaggtggcaaaaactgtcagaatcaacttctgaagtactctgggatctagctttttgttagctttcatttttttgagatggggtctcactctgtcccccagactggagtgccactgtgcaatctcagcccactgcagccttgacctcccgcctcagcctcagagtaggtgggatcacgggcgcaagccaccatgccaggctaatttttgtattttttgtagagacagggttttacaatgttgcccaggctggtattgaactcctgagttcaagcaattcaccagcctcagcctcccaaagtgctgggattacaggcttgagccaccgcacccagccttctagtttttaaaaagggaaacaaacaaacttataactagcacgggaaaatttggagaaagaaagctctgaggctgggcgcggtggctcacgcctgtaatcccagcactttgggaggcaaaggcgggtggatcccctgaggttaggagttcgagaccagcctggccaacatggtgaaaccccggctctactaaaaatgcaaaaattagctgggcatggtggcacatgtgcctgtaatcccagctactcgggaggctgaagcaggagaatcccttgatcccaggaggaggaggttgcagtgagccgagatagtgccactgccctccagcctgggtgaaagcaaaagtccgtctcgaaaaaaaggaaagaaagaaagctctcctgtgataagagagtgtgattgatggcgtttttgcttgctcatgtaacatccccccaaactccagatcagcagggaccatgaggatgtcagcctgcacttctggggctggttgctagcgtagggggagtacacagaatttactctcaaagaattgtggttgtaggctgggtgtggtgtctcacacctgtaatcccagcattttgggaggccaaggcaggtgaatcacgaggtcaggagtttgagaccagcctggccaacatggtgaaaccccatctctactaaaaatacaaaaaattagctgggcatggtggtgggcacctgtaatcacagctactcaggaggctgaagcaggagaatcacttgaacctgggaggcagaggttgcagtgagccaagatcgtgccactgaactccagcctgggtgacagggcaactccgtcttaaaaaaaaaaataaataaatttggggttataggtctgacgacttccccaaggactagcagaaaggtttctgagctttttaaccagggcattttcagggctggcatggcttcccaggtggctttagacaaaagcattgaaagacataggtattggcctcaataccctggggcaggggacaacacttgggacaagcaatagacagaccgagcagcctgggaaggaaaagtttggaaaaagagatgtgtgtctgtagaggcttttaaaagtgtctacataaaccaggaaatcaagaaagctgtgtgcaggcccatagtcagttgcaagctcagaaaaggcctaagaaactttgtgaggccaaggcggttggatcacctgaggtcaggagtttgagaccagcctggccaacatggtgaaatcttgcctttactaaaaatacaaaaattagccaggcatagtggcacacacctgtaatcccagctacccgggaggctgaggcagaaaatcactttacctgggaggtggaggttacagtgagctgagattgtgccactgcactccagcctgggtgacagagtgagattctgtctcaaaacaaaacaaaacaaaaacaagcaaaagaaaaggcctaagaagaccctgggctttcatctctttctggccttcagtctctgtgcaagcaggaagtgaaggctaaggcagagtataaatggcttggttaagggttgagagagtgccccaaacagatccaatttgcaaagactaggatagtgtttttcttttcttccttcctccctccctccctcccttctttcctttcttccttccttccctccttccttcctttctctcctttctgcctgcctgctttctttctctctctctttctctgtctttctctttatttctcctgttttcttgtttctttccttttattcttctttatttgttggcttcagccattttaggtagctctcaaaataccagctgactgacaagcaaaaagaacagaaacaaacaaaaagaacagaacagaaaaaaaaaaaaaaaaaccagaaacagaaacacaaagaatacagactttacaataatagtttggaaaatttaccaaacaagcaaaccacagcaacccacgatatacagcaacaatagaccctggggagggaggagaatctgattttcagtgttgccataaattgaaaatgtcaacaaaaaccctcatggcatggaaagaaataataaagttccactcatttgtggcaagaaagaaatgactagatactgtctttgtggcaacccaggtattggtcttactggcaatgactttttttttgagacagagtcccactctgtcgcccaggctggagtgcaatggcacgatcttggctcactacaacctctgcctcttggattgaagcgattctcctgccttaccctcctgagtagctgggattacaggtgtgcgccaccacgcccagctaatttttgcattttcagtagagacggggtttcatcatgttggtgaggctggtctcaaactcctgacctcgtgatccacccacctcagcctcccaaagtgctggattagaggcgtgagccactgtgcccagcccagcaatgacttttaaaaaaaattatttatttaatttttttttagagacagggtctccctctgtcactcaagctggagtgcagtgatgtaatcagagctcactgcaatctctatctcctgggctcagtgagtctcctgcttcagcctcctgagtaggctggaactacaagtgtgcaccacaatgccaggctagacaattactttttttttttttttttttgagatggagtcacactctgtcacccaggctggagtgcagtggcataatctcggctcactgcaacctctgtctcccaggttcaggtgattctcgtgcctcagtctcccaagtaactgggattacagatgcccgccaccacgcccagctaatttttgtatttttagtggagacaggttttcaccatgttggccaggctggtcttgaacttctgacctcaagtgatctgcctgcctcagcctcccaaagtgctgggattacaggcatgagccaccatgcccagccgacaatgagtgtaaattgactgtcttaaatatactcaaagagatgaaggaaaccatggacaaagtcctaaagagagagcactttgcagaagttgtggcgccttgagagccagcagggcagtgggccagtgagatgttgagttattactattattaattcaaatcacatgaatagcaaaccctcagagaacaagaagtctttgttgtatcacaagggctccatcagcagaggtggagtcctgaactcggcacagtgtctggcatatactaggtcttcaagaaagttttagagtaaacaaatgcatccacaatgcttttatgttgggtaaggtctttctagcagtcaaaattttctttctttctttctttttttttttttttcctccttgtgatggggtttgcgggaatgggaacaatggcatagaggaagaggaaaccaaaattatcttgagttagcagatgtctttctcctgtctcctttcttcactaagaagaacagtctttgctgggcatggtggctcccacctgtaatcccagcactttgggaggccaaggcgagtggatcacctgaggtcaggagttcgagaccagcctggccaacatggtgaaaccctgtctctactaaaaatacaaaaattaggtggggtgctgtgtggctcactcctgtaatcccagccttttgggaggctgaggctggtggatcacctgaggtcagaagttcaagactagcctggtcaacatggggaaaccccgtctgtactaaaaatacaaaaaaaaaaaaaaaatagctgggcatggtggtgcatgcctgtattcccagctacttgggaggctgaggcaggagaatcgcttgaacctgggaggcagaggttgcagtgagctgagatcatgctattgtactctggcctgggggacagagtgagactctgtctcaagaaaaaaaaaaataaaaaaataaaaataaaaaacctaaagaaacaaaaaaaaaaacaaaaattagccaggtgtggtggtgcacacctataatcccagctactcgagaggctgaggcaggagaatcgcttcagcccagggatgcagaggctgcagcgagccgagatggcaccactgcactccagcctgggcgacagaacgagactttgtcttttttttgtttgtttaaaaaaaaaaaaaagaaagaagaacggtattgtctttgggtaagcacaggcacagagttaaaaaaaaaaaaaaaagagtcgtgtctttgggactgagtggatgggcatgtgttctgagttagtgtgcccaggtgtggtgaaagacacggagaaaccactgcttgatgcgttctcttttgttgttcaagttgtgggctgctgtggggtggggttacatgtctgcatccccttcgaaaagcacacaatatggcaagtggaagctggagagagctcctaggagtgcctcgtgccaggtgaagaggttgcattgcgggtggtgggtaggtgcctagggagaggaggtccacgcctgttgtccttccagcacgatggctccaaaagcagagcgaagaggtgatgttcccacttcccaaggcatccaagggacggggcttgaagaatgcagcctagcaaccatgtgcgtaagactgtggggaaggagggcttgaggatgagcctgagagtcaactggactgtggggaaatagtgtagccttctttcctttgagcttcagttatctcgcctgtggtgatgatgacgatgatgataaagatgataccatacttctatggcacatactatgttccagatattgttcatataactcatctaattttcatagcagttttacaagatgagtactatttgtttttgtttttttgttttttttttttgagatggagtctcgctctgttgccaggctagagtgcagtggcgcaatctgggttcactgcaacctctgcctcctgggttcaagcaattctcctgcctcagcctcctgagtagctgggactacaggcacataccagctaatttttgtattttcagtagcgacagggtttcaccatgttagccaagatggtcttgatctcttgacctcgtgatccacccgcctcagcctcccaaagtgctgggattataggcgtcagccacagctcccagccaagatgggtactatttttatacctattttatagaagaggaaactgaggcatagagaagtcaagtcacttgatcatacagctagtgtgtggaggaggcagattcaaaccctggcttcggtcttagtcactgcattggcttcatgggcttatcatgaggattaaacgcgtgaacatgctcagtgtttagttcagtgtctggcacaggatcaatgttcagaaaatcctaacagctgctgtcagtatcagaacccaaacaaacaggtgggactttcgccaactctctaacatcacatgtgcttgtataatcagccactgtttttttcatgaaaaaaaatttttttgagacaggttctcgctttgtcacccaggcaggaaggcagtggtgagaacacagctcactgtagcctccacctcctgggctcaagcgatcctcccacctcagcctcttgtgtagctggaaccacagcatgtgccaccacgcccagctattttttaatatatttttttattttttgtagagatgaggtctcaccatcttgcccaagctgttctcaaactcctggactcaagcagtcctcctgcctcagcctcccaaaaggctgagaatacaggcatgagccactgcgcctggctaatcagtcacttgttgttgttgttttttgtttttttgagatggagtcttgctctgtcacccaagttggaatgcaatggcgcgatctcggctcactgcaagctctgcctcctgggttcaaatgattctcctgcctcagcctcccaagtagctgggactacaggtgcacgccaccacacccagctaatttttgtatttttagtagagacggggtttcaccatgttggccaagatggtctcgatctcttgacctcatgatccgcctgcctcagcctcccaaagtgctgggattacaggtgtgagccttaatcccaaagtgctgggattacgtgcctggccttaatcaatcacttttaaaggagagtggggaacatcatgttttgcaactattttttgaactcttggatatttacttggaacaaataaaaacacttttgtaccatgtgaaaggtaaaatttgctcaagccgtccctcatcctgccctggcctgcttccacatgcggctgggtgagctgaccccattctctgtttatttattgtttttgttattgtattttattttacttttttgagacagagtttcactcttgtcacccaggctggagtccaatggcatgatcgtggctccctgcaacctccgcctcccagattcaagcgattctcttgtgtcattctcctgagtagctgggattacaggtgcctgccaccacgcccagctaatttttgtatttttagtagagatggggtttccccatgttggccaggctggttttgaactcctgacctcaggtgatctgcccgcctcggcctcccaatgtgctgggattagaggtgtgagccaccgcgcccggcccattctcagcttcttgatggcttccccctactgggacattgatcacttattcatgacattgactggtcatgagccactcctccgccagcccttggaggatccaagtgattcacaaatggacacaaggaatatgattagtcctctgtgagtgattctgaggggccgtggtatagagagagagaggggaaggaggatgggaaaatgccggcagttccctccccaacccattctgacagtttgctggttagagaaaaatccccatgtcagagaatttttttctttgtttatttcctgtgaaatagaatgtgggtctggcattggggaggactctagtaattcatattttctgcttatttggctcctggctgaacaggaatttacattacttaatgtctgggtttttcctggggaatcaaaataagttttctattcaattattaagcaaatttcacagccaaataatcctcttatttttacaagtggtattttccctggcagagggttttctggcttctctgggtacttgatccgtctcctctcttctgtttcctctgtctttgtctggctatgaaggaagctaaagcccctcattcatggattaggggcttctcaatggcagttggcagactttggctttgcaagctagagatgaatcttttttttctttcttttttttttttttcgagacggagtcttgctctgttgcgcaggctggtgtgcagtggtgcgatctccactcactacaacctctgccttccaggttcaagctattctcctatctcagccttccaagaagctgggactacaggcatgcaccaccacacctaatttaaaaaatactttagtaaatggctaatttaaaaaatatttttagtaaatgggaggttttaccatgtcggccaggctggtctcgaactcgtgacctcaggtgatctgcctgccttgtcctcccaaagtgctgggattacaggtgtgagccactgcgcctggcctagagataaatcttaatgtccgccagccatggggtaagagtccactccctctttctgctcttcagtctattgactttgggcacaggcacagctgcagctctagtaggggttgggcctggagtcagtggagacaaaatgtgaaggtaacaggacagtgcacggggcccagtgtgctctgcctgggctgctcagggaagaaaaatcacacacacacacacaaataacaaccctttttttggcagaagtatagtgaaagatctctacgtcttggccagcatttgttatctttttgcttctttgaaaatagccatcctgggccagatgcagtggctcacgcctgtaatcccagcactttgggaggctgaggcgggtggatcacctgaggttaggagtatgagagcagcctggtgaacatgatgaaacctcttctctactaaaaatacaaaaattagctgggcgtggtggcacgcgcccataatcccagctactcgggaggctgaggaacaagaatagcttgaaccctggaggtagaggttgcagtgagctgagattgtgccattgcactccagtctgggtgacagagtgagactctgtctcaaaaaataaataaataaataaattaaaaataaataaataaataaaggaaacggagtcagtgtgttgaagagatatctgcactcccatgttcactgcaatattattcacaatagacaaggtatagaatcaacctaagtgtccatcagtggatgagtagataaagaaaatgtgatacacatacaccaatgtggtatatatactcttcagccttaacccatctccataaaattaaggaaacaaagaaggaagtcctgttattggtgacaacgtggatgaacctggaagacattatgttaagtgaaataaatcaggcacagaaagacaaataccacatgatctcacttatatgtggaatctaaaaaagttgaactcactgaagtagagagtagaatggtggttaccagaagcaaggtgagggtgtctgtgagagggttggggagacattggtcaaaagataaaaaatttcaattagccaggaggaaaaagttcaagaggtctattgtgactagttaataaaagtgttctaaccacaaaaatgatccatatacaaggtaacatatatgttaattagctttatttagccattccacactgcgtatatcaaaaaatcatgtacaccataaatataattattattattttttgagacagagtttcactcttgttgcccaggctggagtgcaatggcacgatctcagcccactgcaacctccgcctcctgggttcaagcgattctcctgcttcagcctccctagtagctgggattacaggcatgcaccaccatgcccagctaattttgtatttttagtagagatggggtttatccatgctggtcaggctggtctcgaactcctgacctcaggtgatccgcccacctcggcctcccaaagtgctgggattataggcgtgagccactgtgcccggctcataatttttatttataacaaaaagtaaagtgaacctcctgtagacagagtacagttggatcttgttttttcaacctattcacctactctatgtcttctaattggggaatttaattcatttatacttaaagtaattattgatagataatttacttagtagaagtataactttgagcctgttatttaccttttctaaatgagttttcatttctgtgaaatgggcacaattaaagaggccgcctcctgggactggggtcaggattagttgagatagtctgtgtaaggctaggatggtgcttgacagccagtgttaattattattttttgatcctgtgggatagggcaacccagatactccggtgggaaacacttgcaaccagagaaccttgactcaaaatcttggtcctacttggtttgaaggatcccattgcatttgcattgctgccccttctgagaggttattcacactgataaaccccattttgcaacttacacgtgcaggattcagctaattggacagcagtggacactgaacctaaggtgaaaaatccaacaaatagagaggaccaactgaaaaattcagttgctttcttttgaagaatctgaatacgagacacagagaaaggattagtagtcagtattgagggcagaaacagaaacacagagaaggaaagttataagaggaagctttgagtcagcagaagctatgggtgaataggagccatgaattgacaggaattatgagtcagcagaaacttgagtcgtggcaagagccacaagtcagcagaaactatgagatagagagtagcatggagatagcagaggaataggccaagacccggagatgctgcgtcaccatcttggtggagcctagagggcagagctaggatggtcccctgaattacagagctgctgtcagtgatgagtgtaacctgaagatgttccagcctctggcagccctgactgggtggtgagactttggccttccagctttcataaagtaaactgagaatatttctgtttctggccaacttacaagaatctgactgacacactacccatatcaaactcctctgagactcagttttcttgcctgtgaaatggggacagctaaatatacaagttgaatgggttgagaaaacaagatccaattatattctgtctacaagagactcattttactttttaattacaaataaaaattatatgtatatatgatattttgatatatgtatacagcatggaatggctaaatcaagctaattaacatatatgttaccttgtatacttgctttgggctgcttagcatcccttttttggggataccagcctttatttgacatctgccagtaacaggattctacctctaaggtggccacataatccaggccgggcccgtcagagcctcattgtagaaatttgccttcaggtcaggaggtggaaaccctgagagagttcctgggttctgggatattctaagctgtccaggctcctgtgttttctttgtttttagagacggagtctagctctgtcacccaggctggagtgcaggggcacaatctcggttcactgcaacctccgcatcctgggttcaagtgattctcctgcctcagcctcctgagtagctgggattacaggcatgcgccactatgcccagctcatttttgtatttttaatagagatggggttttgccatttttggctaggctggtctcaaactcctgacctcaggtgatctgaccgccttggcctccgaaagtgctaggattacaagcgtgagccaccatgcctggccggctcctgtgttttctaaggccagtttattcaactctgttttctttctgagagtttccgaatggagtcatcccttggtatccatgggggattagttccaggactttccatggataccaaaccccacagaagctcaagtccctgatataaaatgatgtagtctttgcatttaactatgcacatcctgctgtatactttatttttatttattattattatttttgagatggagtctccctctgtcacccagactggagtgcagtagcgcaatcttggctcactgcaacctccgcctcagctaggttcaagcgattctcatgcctcagcctcttgagtagctggaactacaggtgtgtgccaccacgcccggctactttttgtatttttagtagagatggggtttcaccatgttggtcaggctggtcttgaactcctgacctcaagtgttctgcccatcgcgacctcccaaagtgctgggattacaggcatgagccaccatgcctggccctcctgtatacattagattatctctagattactcataaaaatgaatacaatgtaaatgccgtgtaagtagttgctatactgcattgtttagggaatcatgacaagaaaaggagtctgtatgtgtttagtacagatggtttttgttgtcgattaaaaatatatatatattttatagagacggggccttgctatgttgctcaggctggtcttgatcttctggcctcaagtgatcctcctgcctcagcctgccaaagtgctgggattacaggcatgagccactgtgcccagccttcctgaatatttttttaattctcggttggttgaatccatagatgcggaactcacagaggcagagggccaactgtagccttcctacagatatttttatcttgttaaagtaataaccctaacctgacccacacctcacaggtctgttgtgaagtgacataagccagcacataagtggaaaagcttggtgaatgatttaaaggaatcttctggcctggtgcgggggctcacgcctgtaatcccagcactttgggaggccggagtgggtggatcacctgaggtcaggagtttcagaccagcctggtcaacgtggtgaaaccccgtctctactaaaaaaaatacaaaaatcagcccggcatggtgacgggtgcctgtaatcccagctactcgggaggctgaggcaggagaatcgcttgaacccaggaggcggaggttgcagtgagccaagatcgtgccactgcactctagcctgggggacaagagtgaaactccgtctcaaaaaataaaaaaaggaatcttctggcctctgtttcagttgaacaaagtgaggtctagagaggggagaagtgagcagttccaggtcgcatgggcggtcaggggtgaaaggggagtggggacgtgaactccaggcgggtgctctttcgcgcctcctggtcgctccctccccttccctccccttccctccccttccctcctcttccctcccccgctctccctgatgtgcctgccttccctacctaacagctctgagttctgcctacctgaattagcccaatgttttcaccctttgaaagaagattctaagccgaaaccagcccccagttccccgtgggctttgcccactccttgccaagcactctgagtgctaccctttctctttctgaatagggtgagatacttgacgctgccctgaatcgaagtcaaacgggggctcctctctgcagtaccacagagctccctgtaggtggcagggtaggactgcaaatgtcctggaatattggtccctgagcgcaagcccagactggagctggggtacagcatttacttgccgtggggaagaggaggacgccggagggaggaggaaggaaagtagaagtgttgccagtcttgaggcaaaagagagttgatttgagggccgaaggacaggaatagttggtgtacctcatccgtctatctctccatccacctacccacctatatacccaactaccctccatccatccacctactctccattcacccacccactcacccatccacccatccacccacccacccatccatctacccatccatccatccatccatccatccacgcattcatccaaacacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataaccggtactgccttttgttgagtgtcaaggttgcttttatctctccagctggagatttctgcacctgtctgtagcatccattactagcatcccattcccaatattattattcactcctttacttccgaatataaagcagatgtcatctggggccctttttgccccttctgatttcaataaaattttccccaacgtcctgtcttcctcctcctcctctatcccattcctgaggcatctcaagtcttcccttggatttctgtcaactcctgacttttctgcctctagagctttggctcctagtaggatatttctgacctgcagcatatcatattctttgtttttaaaatttattattgttggccaggtgcagtggctcatgcctgtaatcccatcactttgggagaccgaggcaggtggatcacctgaggtcaggagtttgagattaacctggccaacatggtgaaatcccgtttctactaaaaatacaaaaattagctggatgtggtggcatgctcctgtaatcccagctactcgggaggctgaggcaggagaattgcttgaacccggagggagaggtttcagtgagtcgagatctcgccactactccagcgtggacgacagagcaagactccatctcaaaaaaaacaaaaacaaaaccaaacaagcaaacaaaaaaaaaaaaacaagaaaaggcagctcagagaggtcaagtgtctagcttgaggccatacagctaactgggtcagaactgagatttgaacccatgtatgtctgacctggtgctgggctcttttctgtagaggattcatccagccccacatacctggtctagaagaagggaagtggtgggagaggagcaccccagagagaggagcccgaatcatggggctgcaagctggtcctgggtcccatggagccatggggtgaggaagtggcaggggctaccaccaaactcagatgcgggcccaaggctggttgggggagaggaccctggctgtgggtgcccatctgccagcttgtatgaaggagtaggcggggtaggtgggagaagggaagtggtgcttcggtgggaccacaggaaacgctagattttggttagtagttggaaagtaccagcaatttctctttcaacagaaaaccagaaggaggtcaggtttttcttattaaaacagagacaaatgcagactttgcaaaggaagcagggatttgcagagtgaggctggaagtcaccgaagctgagtgatattccccagagaaaggttttacattcatgtggagtgggtcagaggaccttgagttgagctgatgagcagccacaggatggcaccaggttttcacgatatggagagaaggggacctggtggtggtttggccaccgtgtcctgtttcctgaagaacagagggtgtacgtgacagctggggcctcatagccagttactgccagcaggactccatctcaattcagatcttacttcatgggactacacagaaagaaggaaagccaggccgggcatggtggctcatgcctgtaatcccagcactttgggaggctggggtgggcagatcaatagaggccaggagttcgagaccaacctgaccagccttcaccaatggtgaagcccatctctactaaaagtacaaaaattagctgggcgtggtgacgggcgcttgtaatcccagctacttgggaggctgaggcaggagaatggcttgaacccgggaggcagaggttgcagtgaggcgagattgcaccactgcactccagcctgggtgacagagcgagactcggtctcaaaaaaagaaaaaaaaaaaaaaaagctgggcttcgtgaagggctcacacctgtaatcccagcactttgggaggatcactttgggtggattgcttgagcccaggagtttgagaccagcctgagcaacatagcgagactccatccttacaaaagataagaaaacaaaagacagaaggagtggtttggagctatgcaagtgtccctcttggctctggcaatttctgggtggataaccttgggtagcacccttctctttgaatctaagtttccttatctaaactggcgatgataagacctcccttgctatgttgttataaaattacttgtgtgcctagcccagagtaggtgtgcaatgaatgagtaaatggatgaatggctaaattccacacatatttatggagtgctaagtctgtgtcaggcattaccttggggacacagctggaagtgaacaagccccagtcttcggtttttaggagcccacattctggcagaagagacaggaagtagctgggcagggtggctcatgcctataatcccagcacttcgggaggctgaggtgggctgatcacctgaggtcaagagtttgagaacagcctggccaacatggtgaaaccccatctctactaaaaatacaaaaattagccaggcatggtggcatgcacctgtaatcctagctactcggggggctgaggcagggaaatcgcttgaacccgagaggtggaggttgcagtgagccgagatcgagccaccacactccagcttgggtgacagactgaaactccatctcaaaaaaaaaaaaaaagagagccaggaagtaagtgagacagataagatcaacacagagcatgctaaacagaaaagtaggaaagacatactattcagtgttggggtgggtggggagattaatatttcagaaagggtagcctgggaagggctcattgagaagctgactgttgaataaagattggcaggaattacgcaaccagccgtgtagatctctgggagaggagaattccggggagaagggacagtcagtgcaaaggcccttaggccagagcatgcttggggttcaagaaacagagtgagtgccagtgtgcctgaagcccagtacagaagggagaaggttgtcggagatgaaggcaaagaggtaatgacgggtgggttagagtttgcagggcctttggaagctgtgagaaggattttggctttttttctgggtcagaggggagccagtgcaggagtttgagcagaggagtggcatattacggttctccagagaaagggaaccaacaggatatacacatgtctacattaatcaattaattattttgagggggttctccagagaaagggaaccaacaggatatacacatgtctacattaatcaattaattaattttgagattgagtttcgctctttcacccaggctggagtgcagtggcacgatctcggcctactgcaacctccatctcctgggttcaagtgattctcatgcttcagcatcccaagtagctgggattacaggtgcccgccaccacacctggctagtttttgtacttgagacagggtttcaccatgttggccagcctggtctcgaactcctgacctcaggtgttccacccgcctcattcttcccaagtgctgggattacaggcatgagccaccatgcccggcctatattaatttctttacagagatttattataatgaattggctcgcatgattatggaggccgagaagtcccaagatcggcagctggcaaacaggagacccaggagaactgatgatttagctccagtgtgaggcccaaagaccctgtgagttcccaggagagccaatgacataagttctggtcctaacgcgagcagacttgagatgcaggaaaagccaatgtttcagttcaagtctcagggtggaaaagcacagtgtcccagcccaagcaggcaggcagcaggagttctcttgtactgtgcctttttgttctatatgggccttcaacggattggatggggcccacccacattagggagggcgacttgctctattcagtctgcagttcaaatgtgaatctcacccaggaacacccttacagacacacactcacaataatgtttgaacaaaaatatctgggggccaggcatggtggctcacacctgtagtcccagcactctggaaagccaaaatgcgtggatcacttgaggccaggagtttgagaccagcctgagcaacatgacaaaaccctgtatctataaaaaaaaatacaaaaattagctggtatgatggcaccacatgtggtaccagctactcaggaggctaaggtggaaggatcgtctgagttcagggaggttgaggctgcagtgagccatgactgactgtgccaccgcactccagcctgagcgacagagcaagaccttgtctcaaaaaaaaaaaaaaaaaaaaaaaatctgggcagcccgtggcccagtcaaactgacacatcaaattgaccatcccaagtggcttcactggatgtagctttctacaggctctctctggctgtggtgttgagaatagtatgaaggtaggggtagggttggggagtcagaagcaggaaggtgaatttggtggctaccatatagtcatccaggtaagtgtggtggtggcttggactaaagtggtagtaagaggtgtgacgaggttattagattctggatgtattttgaaaggagtgcagatggggtgagagagagaagaagagaaataatgggtgacctgtggtttttggcttcagcaccttaaagaatgaggttgccactgattgagaagggagtatcaggagtatggcggacacgttgagtgtgagaaatgtaagctttggaggagatgtggggtcagcaggtagatgtccatgcctggagtccagcagagcagcctgggccagacagctggatttgggagctgtcattagcacctgcctggctgtcttcattattgcatcaagagtggctcttggttgcaagtaacagaaaacctggctgcaggccagacatggtggctcacgcctgtaatcccagcactttgggaggccgaggtgggtggatcacctgaggtcaggagtttgagaccagcccggccaacacggtgaaaccctgtctctactaaaactacaaaaattaaccgggtgtggtggcatgtgcctgtaatctcagctactcaggaggctgaggcaggagaatcgcttgaacctgggaggcagagtttgggtaagctgagattgcaccattgtactccagcctgggtgacacagcaaaactccatctcagaaaaagaaaacttagttgccttgagcaaaaacagaaattattggaaaactctaggggtccacaaacccaccaggaagctggggatccaggctggggaaatgagtgggggccaaggaggctgtgaagatctgagcagcggcagccacagaaaaggccccggcaggagcaatccggtcctaaaacccccatggctaccatgtggataggccctcctgcggccccttgctgggatcaccgctcatgatgcagagtctgaggagagcagctcattggttcaaccaagccacatgaccttcaggctggggtgcagggagggaggcctggccacttagggtttccattttcttttttctgagacagagtctcgctctgtcacgcaggctggagtgcagtggtgtgatctcagctcactgcaacctccgcctcccggattcaagtgattctcctgcctcagcctccccagtagctatgattacaggtgcgtgctaccatgcttgcctaattgttgtatttttagtagagacggggtttcaccatgatgaccaggctggtcttgaactcctgaccttaagtgatccacccgtctcggcctctcaaagtgttgagattacaggcgtgagccactgcacccagcccactgagggtttcctagtggaggaggaggccaccatcccctcattgtggtgtttataatggggaactcccagaggagccaccagggtaaaagaggaagagatgagatgttggactggcataaaaaaagaaaagcagaccaaaactccagcgtgacagcagcaaagcccatcacaactgcatcataattatcatcagcagcaatagcagctggagtgatttcttttctttttttgagacagggtcttgctctatcacacaggctggagtacagtggtgtgatcgtagctcactgcagcctcgacctcccaggctcaagcagtcctcctgcctcagcctcttgagcagctgggactacaggcacaagccactataccaggctaagttaaaaaaaaaaaaaaaagtgtagagatggagtctcacttaggctggtcttgaactcctggcctcaagcaatcctcctacctcggcctcccaaaatgctgggattacaggcaggagccaccttgccaggctgatcttttaaattctttcagcgtcaaagccaaagttttctcaatgtcctaaaaggccccaggccctctgccctccctcccctgctaccccgccctgtggcctctctgacctcatctcctgttgttcctgccttgctcattcttccccagcctcactggtcccctggctgcggctccaaaacgctggccactcctgccccaggacacttgcctttgctctcttccgtgcccttcccagacatccccacgacttgctcccttactgccttcaggcttctctctctctctctctctcttttttttttttttttggagatggagtctcactctgttgcccaggctggagttcagtggtgtgatcttgcctcactgcaacctccatctcttgggttcaagtgatccttctgcctcagcctcctgagtagcgggggttacaggcgcatgccaccatgcccggctaatatttgtatttttagtagagatggggttttgccatgttggccaggctagtttcaaattcctggcctcaagtgatctgcctgcctcagcctcccaaagtgctgtgattacaggcatgcgccacggtgccccgctgagacttttctccaatgtgaccttctcagccagacatccttgatgatgccatttacatttgcaatgctccctctatcccatctcctcccaggaatgcctcttcatgtctttgctttttttttttttcccccacagaacttctcatcatcttcatgctacatatctctgtttcttgtgtatctccctcctccatgtggatgggggtttccagaaccgagcctggtatggagcaggcggtcaggatttgctcttgaatgaaggatgggggttcactccctggagctatgttgggagccctgttctgaggagctctggcttcgtgggtccccaggacccagggtaagacagtccactccttgggcaatgactgggaccagtacctggggaggttggggcccttcatcccaactcagtcccatccttgagggaatcaactgtgactcacagctaacagggtgagcagagctgcttcttcagtcacgaatgaaaataaccttgtctctgtaaacaaacagctctcaatttattcattgggaagaaagaagtgtgtgtggaaagaaggaggcactttcctggggggcggagtgtcagagtgttagacttgagttactcagagtaattgattcacgatgctgcgtgtcaggggtgttacatctaatcgggagctgtccatacaatttctcactaattgtcactgggcgccataacaggataatgactgttggggcacaagagacttggatgtggtgagccaagggtatcattttgatttttgttttgagatgtgctggaactcagatgaccctccttaccgaaaggctccatccctttaaatttttttttttttttttttaagagatgatgtttttctgcgctatgttgcccaggctggtctcaaactcctgggcttaagtgatccttccacttcagtctcccaagtagtggggaatgcaggtgtgagccactgcacccgactgaaaagctcattctttttttgttgagacagggtctcacgctgtcacccagacttggagtgcagtggcgtgctcacggctcactctagccttgacctctcaggctcaagctatccttccatctcattctcccaggtaggtgggactacaggcatgtgccaccatgcctggctaatttttttattttttgtagagacgggggtctcactatgttgcccaggctagtctcacactcctgagctcaagcgatcctcccaccttggcctcccaacatgctgggattacaggcatgtggaaggttcattgtttagccagagttttgttctggaccggagacaatctagagggatgcagacctgggcttggaccaccagaggtctggctggacccctgggggccagaagtgcctagttgaggggtatcttcttggactcgttacttactcctcactttgaacctgtcaccaagtgtgtcagttttgcctctaaagcatctgtcagctctgtccacttctctccactcccactgccaccccctgctttcacctggtgaccacagacgctgcttagcttctgctctgtctcttattcccttccctttgcctctacccgggagcatacatgtaatggtgacagttccctgcataacacactgcagcggtcccattcccttgaggatgaagaccaaaatccttaacatggctcaagagatcccacaaccatctggcccctgcccacttctcagcctcactgttcaccattttctccaggcaaaaggaaggaccagtgacctaagaatgccatggggctgctgccctcattttgcactctaggattttgaccttattatttcctgtgcatgggatgctttcttcccctccctccctccctttcttccttccttccttccatccatcctctttctttctctctcctctccctctctctctctccctccctccctcccctcccctgcctcccttcctcctcctcctccttctttcccctctctctctctttctttttgagacagggtctcattctgtcacccaggctggagtgcagtagtgtgatcgtggctcactgcagcctcaacctcctgggctcaagtgatcctcccaccctagcctcctgaggagctggataccactgtgtgcagtgagtgcatgccactgtgcccagctaattttttgtattttttgcagagatggaggttttgccacgttgcacagtctggtctcaaactcctgggctcaagtgatctgcccacctcggcctcccaaagtgctgggattacaggcatgagccaccgcacctggcctaggagctgcttcttagatcttccgcagctctttctcatcaccagctaaaatgctgtattctggtagcattgtctttatcctcctctggactgtatctctcttgaagtcttccattccagttcatttctcctgagcctagtacaataatacatagaaagcgctgggatatttttaaaaatactaatgtttagaatcaattttaattccttctgtaaaaaatatacgtattttgcctttttaaaaaaatgcaaaactgggccaggtttagtggggcatgcctctagtcccagctacttgggaggctgaggtgggaggatggctggagcccaggagttcgaggctgcagtgagccatgattgcaccactgcactccaacctgggcaatagagtgagatcctatctcaaaaaaaaaaaaaaaaaaaaaaaaggaaaactcaagtccttttagtgatcacaccaagttcctgcaccttgtcgcttttttattttattttattttatttttttgagacagagtcttgctctgtctcccaggctgaagtgcagtggcatgataccaacttactgcaacctccgcctcctgggttcaagcgattctcctgcctcagcctcctgagtagctgggattacaggcatgtgccaccatgactggctaaattttttgtatttttagtagagacagggtttcaccatgatggtcaggctggttttgaactcctggcctcaagtgatccttctgccttggcctcccaaagtgctgggattacaggcgtgagccatcacgctcggccagcccttgtttttatgaacatcgtgtatccttaaggaccttcaaatacttctgcatccatttgtatgcatctttagttttgttctgaaaacctcaagatatagcacgctatgtgtatagtttgcaacttgaatttttttcactcaacactgtgtttctgagaccaatcctcgctgatacatagagagctagttaattcctcctgccttctgcatagcatctcactatgttattaattgccttttgttttctcaagctatttctgtgttgatgggcatttgtgttgtgtctactgccttgctattgaaaatagcacttcagtgcgtgcaccgcgtaggcctctgtgtactaccgtgaagtgtttcctgaggccagtagttctcaacttggctgcagacagaatcacctgaacgttttttttttaacaatcacaccaactctctgcctttccccaaattcttaattgaatggttcagggtaggcatcggcagttttagaagctccagggtgcttctaaatgtgcattcagggttgagacctgctgttctggggtgtacattggggatgttggtgttgcaatgactgggccaaaagaagaacccaaccccgtgttttaccaggctctgcccaattgcctttcaaggtgactgaactgatctacatcctgctggcagtgtgtgagcgaataatgactgttttgtgtgaacaagtgactaccagtcactgcaggtcagtgaaccagagcgttctccactgcacaaactgcctccaagtggctcatcaccatgggctacagcccacaaacgtctgagcttggaatgctttgtgtccttaggtggcagcttggtgcagctgaaaaggtgccaggctgctaatgggacaattcggagtccagttcagacccaggttctaccttgctatgtgtcctcccaggtcacatccccacactgagcctcagcatccctgcccttggagggaggagagctggaaactcacctgcggtcattttcatgtttctcttctgtctgagccacacgttacttgcagcctgtggtctgagcatgggcgttagagcccagtcctgaatagtttctgcactgtgggccctgttggtatctggggaagcctattacccttctcagagcaatgtttctttttcttctcttttctttcttttcttttctttcattttttgtttgagacagagtctcgctctgtcactgaggctggagtgcagtggcatgatcttggctcactgcaacctctacatcctgggttcgagtgattatcctgccttagtctcctgagtagctgggattacaggtgcctgccaccacgcccggctaatttttgtatttttagtagtgatggggtttcaccatgctggccaggctggtctcagacagctgacctcaggtgatccacccgccttggcctcccaaagtgctgggattacaggcgtgagccacctcgcccggccttttttttttttttttttttttagagacggagtgtccctgtgtccctctgtcacctaggctggagtgcagtggcttcatctcagctcactgacctccgcctcccaggttcaagtgcttctcctgcctcagtctcccaagtagctgggactataggcatgcaccaccacgcccagctaatttttgtgtttttcagtagagatagggtttcaccatgttggccaggctggtcttgaactcctggcctcaagtgatctgcctgccttggcctcccagagcactgggattacaggtgtgagccactgctcccagcctctgagcaatgtttctaaatatgaaatccaaaggcttgtgaagacaactgattatatggaaatacagctgatataaatattacaaaattattacaaaaatattacaaagccaaactgtgatatagcaatacccatgcctctttattaacacaccaaataaggcgatctgatggtgggttggcaacattattacgattgcagtttaaagcagtgatgagtgtaaatgatattccaacatctttgcaacaaatgtaacaggacatgaaaatatctgtgattcctgttggtgacaaagttacaggttctgttgacacgacggcagtttgctgcctacactcataatggaaagaattgctacattgcagtttgatgttagtaaaattaagaggtctattttttcttccgagttcattgagttcattgattgcaggttactggcccttgctagagttatatagacttgagtttctttcttttttgtgagttttttttttttttttgacggagtcttgctcgtcgttcaggctggagtgcagtggcacgatctcggttcaccgtaacctccacctcccgagttcaggcgattctcctgcttcagcctcctgagtagctgggattacagcatgtgctaccacgctcagctaatttgtgcatttttagtagagacagggtttcaccatgttggtcaggctggtctcgaactcctgacctcaggtgatatgccccctcccctccttggcctcccaaactgctaggattacaggtgtgagccattgtgccctgcttttttgtggctttttaaaaatttttattttgtagagacgaagtctcactgtgttgtccaggctggtcttgagctcctgagctcaggtgatctttctgcctcagactcccaaaatgctgggattacaggcataaaccaccatcccaggctagacatgggtttcaatctctgctctatagcttcctgtgtgggtgcatttgggtaaattccttttctttcctgagtctcagtttcctcaactgtaaaatgcatgtaagacagtgagctcctagggtgctgggaagagtaaatgtgacaaatcaaattcaacacacatttgtagagaacttttgatgtgctcagggccattttcggtgccaggatgctggaccgaatgagaagggcaaaatccttgcccctctggagtttacagttcgggggcagagacaatgaataatgaggcagataagtaaataacggtttcagataatactaagggcaatgaagaaaatagtacaggtgatatgaaagggaacaaatgcctggtgcaggtgacattaaatagggcaattaggtaataatacagacagaaatgaacaatattgatgcataagacgagagaatgtatttgaagtatcagctcggcacctggtacgtggtgtatgttccatttgtgctggccacggtgatgatgatgatgatgccatctctccggctacactgcgagcacagatcacagctctctgtagctgatgctggctctacccactgtattcggggctggatgaaggtggggccatggaagcgttctacacaagaactcagcagtcctgttggagccagattggaaggaagcaggtctgattaaaggaagataaagtcttctctctgctaagtctcgcagggagagctaggcaatcaataggtctcgcagatcagtggagggtgcttggaatctggcagcatggggctttttaattaaacctataactgtgagaaaaggtaactgccttatttctgcagcttgtgtttctgtctgcctgccagaaactgaacaaatcaatgcacttccagaggttctgaggatcttgacaagggggcctctggttttgggatggccagaccctgcagggataaactctcgagtggccagggtgtcaggtaccaattctggagggtcaggtgttgccttttacatttaaatacccatagcaggtgtgattagcaactgcaattcaggggaaggcgaggccccttcccagccagcagcagcttgccttccaggattttataccaagctggccccctaccaccacaagatgtcaacattcctttttttaatagaagattttcttttattgtgggccaggcatggcggcttgctcctataatcccagcactttgggaggccgaggctggcagatcacttgaggtcaggagttccagactatcctggtcaacatggagaaacccctgtctctactaaaaatacaaaattagcttggcatggtggtgtatgcctgtaatcccagctactcagaaggctgaggcacgatcatcatttgaatccgggaggcagaggttgcagtgagctgagatcacaccattgcactccagcctgggcaacagagtgagtctccatctcaaaaaaaaaaaaaaaaaaaaaaaaagattttcgtttatcatgaagtagaattatgctgtttagggtatggtccatgcaccagcatcacagcatcatctgctgggaatgtgtcagagatacagaactccagccccaccccagacctactcagttagaatctgcattttaaccagatcatcaggaattcatatgcatattgatgtgtgagaggcactgaaattgaacatacatatgagacttagaagacaaagaagccaaatgccaatatgcagaccttatttaaatcctgagagagttaagaagttatctatgagataatttgagatttgaacatttgcagatattaaggaattattcatttcctaggtgatagggaggttttatttcaaaaaaaaaaaaaaagagcccttttggccatgcgcgatggctcatgcctgtaatcccagcactttgggaggctgatgtgggtggatcacctgaagtcaggagttcaagcccagcctggccaacatggtgaaatcccgtctctactaaaaatacaaaattagctaggcgtggtagtaggtgcctgtaatcccagctactcaggaggctgaggcaggagaattgcttgaacctgggaggcagaggttgcagtgagccgaggtcttgccactgcactccagtctgggcaacaagaatgaaactctgtttcagagaaaaaaaaaaacccttttcttttagagttacacatgaaaatacttagagataaaatgatttcatgctcgcatttgttttaaaatactggtggagctagacaaagtcttgacgtttggacacagcacgaatgactgtgagttgatggtatggggaactgtgtcacgacccaggcagacacagtacacagtatactgtttacttagtatatgtttcaaattccccacggtaaaaacctaagatgatgatatagaatattcacatagaaaatgcatgaaacaggctgggcacagtggctcacgcctgtaatcccagcactttgggaggacaaggtgggcagatcacctaaggtcaggagtttgagaccagcctggccaacatggcgaaaccccgtctctactaaaaaatacaaaagttagctgggcatggtggtgggcgcctgtaatccccgctactcaggaggctgaggcagggagaattgcttgaacctggaaggcagaggttatagtgaactgagatcacgccactgcactccagcctgggcgacagagcaagattctgtctcaaattaaaaaaaaaaaaaaaaaaaagaaaaagaaatgcatgaaacaggaaggtgttgtgatgagcattagttcaagtggacatccataaatctgttaccaggtcattaccggctcctgccctctgtcagaacctctgccccagagtaatttcttccctcccattctctggggcgctctcacccctagctgcctatggaatcgcctgggaaaactttacaaaacaatgcagttgagcctcctccagtccaatgaaaacatactccctgggagtgcgcacaggtgattctaatgtgcgaccttagctgccctagcttttcaggtgaatgccatatttgtgcttgaatttctcaacgagcttactgctgcttacatccaacaggcaatttcactttctcatcaagggactgagttgctggactgttgtataagcacaggttacattgcaacccatttttttccttttttttttttttttgtttgagactatgtttcgccgtgttgcctaggctggactcaaacttctgggctcaagtgatcctctctcttcagcctcttgaggagatggggctttagctaccgtgcctggcttgcaacccatttttgaaactaatgggtttttgtgtatttgtgataaatgtgtatctaccacatattgagtgctttccatttctctggaactctgctaagtactttattttatttaatccccaaaacgattgtggggtcagcatccctgtccctattatactgatgaagaaacaggctcagagagactatgtggcttgcttcaggtcacccagtttaaaaagtgctgagtgtggattgggttcatagctctctgacttaatgctcttaagcatcattttgtgccgttcattcagggtcttgattgaagagttgagggccagttagccacccacaatgaactggaagtaaacatggagaggtcgtcacagtgtcactcgaggcacacttaagtggtgtgccttggagctgagtttccgtctttgtcaaatggggacagcactgttttgtcttctctggctgacaacctcttactcatctctcaaaagtgcgtcagttgtcacagaatggggaagccggaaagctcctctgaatttcaagggacctcctggctaaagcagaattagtcatgtcctcctctagcctcacagaccacttgtccaggtctctgagagcagtcgacaggagccctacacttgtcatgtgagacactggcgcgtctaagaacaggtgctgttttgtagctatttctctgtctgcagagtccagcccaggggctggagcatggcaggggcccctgcatgtctgcaatttgaatgaaagacgagggtactgctcaaacaccaaagctttggtcagagcctaggatgtactgacacaggaccctttgggcagagatatatcacacacagccacaggagagtggttaggaacctggactctgaatgaagactgcctgggttcaagtccaagctctgccacttacaagctgaatgaccttgggcaagttatctcacttccctgggcctccctttcctcatctgaaaaaatggctacattgcagccttgttataaggattgaatgggtgggtgcagtggctcatgcctgtaatcccagcactttgggaggccgaggaaggtggatcacaaggtcaggagtttgagaccagccaggccaacatagtgaaacccgtctctactaaaaatacaaaaattagccgaaaaattaaccgggtgtggtggcacgtgcctgtagtcccagctactcaggaggctgaggcaggagaatcgcttgaacctgggaggcagaggttgcagtgagccgagaccatgccattgcactgtagcctgggtgacagagtgagagactccatctcaaaaaaaaaaaaaaaaaaagaaacttaactgggcatggtggaatccacctgtagtcccagctcctcaggaggccgaggtgggaggatcacttagcccaggagtttgaggctgcagtgagccactgcactccaacctgggtgatgtagtgagaccctgtcttaaaagaagaagaagaaaaaagaatgagtttgtattttaaaagcacttcaatgatgcctggcactctggtgccaggggccaaaggaaaagttagtaataccaatcatttcctgaagactgtgatatttgtttatcatgggtatttttgcattaattttgcattaattttttcattctttttcgtttttaaacatattgcatccaagtgttatttatcttgatgactgggtgtttggtgcctccttaaattttgctcccggggagaatgtctcacttgcctctccctcatcccggtcctggcacctaagaagcaacacatcagttctcatttgtctggagggagctcagcatcattatatgtatttaaagaaaaagatgaatgtgtatatattaccaatacttattcagaatctacaaaactctgagcactggggatgggactgtgtgatggttaataccgagtgtcaacttgattggattgaaggatgcaaagtattgttcctgggtgtctgtgagggtgttgccaaaggagatgaacatttgagtcaatggactgggaaaggcagacccaccctcaatctgggtggataccatctaatcagctaccagcatggccagaataaaagcaggaagatggacatggaaggacttgacttgctgagtcttctggccttcatctttctcccatgctggatgcttcctgcccaacataagactcaaagtcttcagtttttggactcttagacctacaccagtgtttgccaggggctctcggaccttaggccacagacggaaggctgcaccgtctgcttccccacttttgaggtgttgggacttggactgatccactactggcttccttgctcctcaacttgcagacggcctatcgtgggactttaccttgtgattgtgtgagtcaattctccttaatacactccctttcatatacacatatatcctattagttctgtccttctagagaaccctgactaatacaggctgggaatgagacattctcagccacggtctttgacctcaaggagttgacagatcactgattattgttaccacttattgagcatttactgtatgcaagacatggtgctagtgatgtttttattaatccttgtggtgacctttccagaaagaatcattacattcattttacagatgaagaaattggactcagagcaattaagccacttgcctgaagtcatgaagttatgagctggggtcaggatgtgaacccagtctccctatctatctatctatctatctatctatctatctatctatctatctacctatctatctatctatctatctatctatctatatcagggtcttgctctgtcacccaggctgggatgcagtggtgtgatcatagctcactgcagcctcaacaccctaggctcaagcgattctcctgcctcagcctcctgaggagctgggactacaggtgcacacaaccatgcctggctaatttttagatttttattgtagagatgggggtctcactatattgcctagctggcctcaaactcctgtggcaaagtgatcctcccacctctgtctcccaaaatgttgggattacagttgtgagccaccatgcctagccctgtgaacccagtcttttagactttctaccacggtatttgggtaagtccagagctctgtccccatcttctgcaagaacatcttgaaagctgaagttatcagatggatttttctgggagttccattgctgagttcctctgattcatgtctcaggaagctggagtctagacgtggcggggcctgtgggaggtggccctccccttttcagagtggatctgtgcagccatctgccatcacccattcctgtgggggaaaacacagattttcctgtgttaaaaaatctctgagacaagactttggcaggatctgaacagactggcgaagtggctccaggatttcctggaaaaggatgagaagggggaaagagagggcaaaggagaggaggagagagtgggagggaaagaaggaggtcagggagaagaaaaatgagcaggaagagccagcagacagcctcccaggtggatgtctttgaaggtaactgaaatgcatggtggggttttcccaaagggtttctgttagacatttcccactcccagtagggaaactggcttccctaatcagggaagggcagttcagggcagtggagcagtgggtgtcgataatgcccatcttgcagactagttgcgaagttccagtgagattgaatatctgaagtgtagtgttggcacacaataggtattcaacaatgtcagttcagttctctccttttttattttttatttttatttatttatttattttttgagatggggagtctagctcttgtcgcccaggctggagtgcaattgcccaatctcggctcactgcaatctttgcttcccaggttcaagggattctcctgcctcagcctcccgagtagctgggattacaggcacccgccaccatgctcagctaatttttgtatttttagtagagacggggtttcaccatgttggccaggctagtctcgaactcctgacctcaggtgatcttcccacttcagcctcccaaagtgctggggtaacaggcatgagccactgcgcccagctagttctctccttttttaaagacaggctcttactctcttgcccaggctggagtacagtggcacaatcatagttcaccacagcctcaacctcgtgggctcaagtggccctcctgcctcggcctcctgagtagctgggactacaggcatgcaccaccacaccccactaattaacaaattagtggaacgtagtggcaggcacctgtaatcccagctactccggaggctgaggcaggagaatcgcttgaacccaagaggtggaggttgtagtgagctgagattacgccactgcactccagcctgggtgacagatcaagactccatctcgaaataaaaagaaagcaaaaggttccttcattctcctgcctttatccattcactcagcacagtgagcacctaagtgtgccaagcactgtccaaggtactggagatataacagtgaacaaaacagacaaaagcccctgccctcgtggagctgagattctactgcggtaggaaaaagtaaaaaagaaatagataatattataggaacttagagagctgtgaaagctaaggataaacaaagcagagaaggaggatgaggggatgttagggatattggtttcctagttttttctgctataacaaattacagcatgaatctaggggctttaaacaacccatatgtgttatcttatagttctggaggtcagaactctaaaatggatcagcagggctgtatttcttcgggaagctctaggggagaaaccatttccttgccttttctggtttctagaggcttcctgcattccttggatcatggccctacgtcattctgatctacatcactcctcagtctctgaccctcttgcttcccttttataagagcctttgcaattagattgagccatacagataatctaggataatctcctcatctcaaaatccttactttaatcacatctgcaacctcctttttaccatgtaaagtaacattcacaggttctgggtatcagcatgtggacatatttggggagggggtagttgtgaattattctgtctaccacaggaacagagattttagataaggtggccaggaaatagcttatttatttatttgtttttagagacagggtctcactctgtcacccaggctggagggcagtggtacaatcatagctcactgcatccttgaactgtgggctcaagtgaacttcccacttcagcctcctgagtagctgggactacaggtgtgtgccatcacacccggctattttctttttttgtagagacagggtcttgctatgttgctcaggctggtctcaacctcctaggcccaagtgatactcccgcctcagcatcccaaagtgttgggattacaggcacaagccaccacgccttcccagaagaacttattgatgtgacttttgagtagggacctgaaggaagtgacggatagacacctggggagagaaccttccagggagaggaaatgttagtgcaaaggctctgaggagagagtacaatgagtgtctgtgtttgaggaccagcggggaggccagaaaggtcacagcagggagatccaggggcagaaagacaggaactgaggtcaaagaggtcctatgggtgggggtaagggagaggtcatgaaaggccttatagatgattgtgagaaaaatgtcttcctctgaatgagacggaaaaccataagacagtttctctaagcacctgttcaataactgactatgaaagaaaatctgggccaggcacagtggctcatgcttgtaatcccagcactttttgaggctgaggcgggtggatcacttgaggccaggagtttgagaccaccatgggcaacatagggagaccctgtttctgcaaaaataaaaacaaaaaattagcctgatgtggtggcgcacacctgcagttccagctatttgggaggctgaggtgggaggattgcttatgcccagcagtttgaagtttgaggctgcagtgagctttgatggtgccactccagcttgggtgacagaacaagaccttgtgtttctaaaaaaaacccaaaaaaacccaaaaaaaactaaaagagataagtgaaaagagaagtgcaaaatgaggtgtaaacatgtaaaaaggtgtaaggaaatatggaagggacacaattgacaagagaccagaaaattcatagaatgaagtcttcaatgtgtgaagggaaagggctaacataattatgtttcaaagaattcaaacaaatcactaagacaagtccctgaatctgggtagaaaaacaagcaaaggggtgcgaaccgtcaactcactaaagagaaaatgcaattagctaagcacatgggaaaagtcagcctaactagtaatcaaagaaatgcaaattaaaacaacaaaccgttatattttcacctcataaagattctgaaaatgagaatcctggctttggccttggtggaatgaaataggtgcaagaaccctggcagtgggaattggaaatctgattattttgggaaacagtttgacactgggtagcaaaaccttaaacatgggcatcctcattggcccaataagtcaatttttggcaatctagcccaaggaaataattttaaatctggagagagccttatgcattgctgccaaacaggagaaacaactaaactgtgagcaataggttaaataggccacggtgctcattcttttgatatttttgtcaatcatatgaattaggtgccagttatgtgccaggcactgttctaggtgccaggaatacagcagtgaacagaacatcttgaactccttgcccttcatggggttctgattctagtgagggagcaggagagcaaataagaacagatatgaagatgctacatgatgggggacaaagtagggcaatgtcacagagagtggaggggactgcagggtggacaaccaccagtttgctggggacattcagttttaaggctggggcagccctggacaaactgggatgagctagtcacactaagagggtcatccttgtgatgggagtggtcagggtcttgtcctctgaggaggtaggatttggttagggactcaatgcaatgagggagtgaacgatgggagtgctggctgagtaggtttccaggctgacagaacaatacctgcaaaggcccggaggaaggagtgttcctggggcaatgtgagggacttgcacaaggctggagtgtctggggcatagcatgaaggaggatggtggtaagatatagatttcagagagggaaactcttgactcttgcagggaaaggaagaagtttggattttattttaaatccagtgaaagcctatggaggttaagcagggaagcaacatggtaaaatttatgcttttagaaagacgactctggctgctgtgtggagaaggtgatgcaggacaagtaagccccaaagttggggcttagcttgggagggttcttggcttcacccaggaaagaattccagggtgagcggtggtggtggacacttttatttttttgagacagttttcactcttgtcacctgtgctggagtgcaatggcaagatctctgctcattccaacctctgcctcctgggttcaagtgattgtcctgcctcagcctccagagtagctgggattacaggcacccaccaccatgtctggctaatatttttttgtatttttagtaaagacagggtttcaccatgttggccaggttggttttgaactcctgaccttaggtgatccaccccctcccaaagtgctgggattacagatgtgagccaccatgcctggcctagacacttttattgaagcagcagtgcacagcagcagcagagggactgctcctcacagagcagggctaccccataggcagtgtgcccagagtagcagctcagaggcagttctgcagtcatatttatacccacttttaatgatatgcaaattaaggggggatttatgcagacatttctagaaaaaagttggtaacttccgggttgttgggtcattgccatggaaaggggcagtaactcctgggtgttgccatggcaatggtaaactgacatgccacgctggtgagagtgtctgttggaaagctgcttccactttggccctgttttttttttttttttttttttttttttttttttttttttttttttttttggtatttattgatcattcttgggtgtttctcgcagagggggatttggcagggtcataggacaatagtggagggaaggtcagcagataaacatgtgaacaagggtctctggttttcctaggcagagggccctgtggctttctgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttggggataaggttacagattaacagcgtcccaaggcagaagaatttttcttagtacagaacgaagtggagtctcctatgtctacttctttctacacagacacagcaacaatctgatctctctttcttttccccacatttctcccttttctacttgacaaaaccgccgtcgtcaccatggcccgttcccaatgagctgctgggtacacctcccagatggggtggcggccgggcagaggggctcctcacttcccagacggggcggggggcagaggcgccccccacctcccggatggggcagctggccgggcgggggctgcccccacctccctcccggacagggcggctggccgagcgggggctgccccccacctcctggacggggcggctgccaggcggagacgctcctcacttcccagacggggcggccgggcagagacactcctcacctcccagacggggtggcagtcaggcagagacactcctcagatcccagacggggtcgcggctgggcagaagcgctcctcacatcccagatggggcagcggggcagaggcactccccccatctcagatgatgggtggccgggcagagacgctcctcacttcctagacaggacggcggccgggaagaggcgctcctcacttcccagactgggcggccgggcagaggggctcctcacatcccagacgatgggtggccaggcagagacactcttcactttccagacggggtggcggctgggcagaggctgcaatctcggcactttgggaggccaaggcaggcggctgggaggtggaggttgtagtgagccgagatcacgccactgcactccagcctgggcaacactgagcactgagtgagcgagactccatctgcagtgccagcaccttgggaggcccaggcgggcagatcactcgcggtcaggagctggagaccagcctggccaacatggcgaaaccccgtctccaccaaaaaatacaaaaaccagtcaggtgtggcagtgtgcgcctgcaatcccaggcactcagcaggctgaggcaggagaatcaggcagggaggttgcagtgagccgagatggtggcagtacagtccagccttggcttggcatcagagggagaccgtggaaagtgggagacggagacgggagagggagacgggagggggagggggagggggagggcagggggagggggagggagaggggccctgttttatagctagtcttcaatttggtctggtgtctgagccccacctctggagttgagtcctgcctcctacctctaaggcatgttggtggatgcagggtagtgggcagaatagaatcatgtagaccccttagaaggttgttgtaatctagggcagtggttctcaattttaaccatgcatgagcatttcatgcaggggttgttaaaactcagcctcctgcccctggagtctacgtctggagtctgcatctctgactagctcccaggtgatgccagtgctgctggtcctggaccacattttgagtagctaaaagctaggagagagataatggggacttgcagtaaggtggtacccctgctgaggttaggaagagctctggtctgggatgcattttgaagtgaaactatcaatctcatttcagttcccttttaatctgcttacaccaaggagaatagctcaatttgatactagtatgtttctaagacttttctgtattttagctaacagaaagcaggcctcaaagtgtagagcaggctgggcgcagtggctcatgcctgtaatcccagcactttgagaggccgagacaggtggatcacttgaagtcacgagttcaagaccagcctggccaatatggagaaaccccgtctctgctaaaaatacaaaaattagttgagtgtggtggcacatgcctgtaatcccagctacttgggaggctgaggcaggagaattgcttgaacccgggaggcagaggtttcagtgagccgagatcaggccactgcattccagcctgggcgacagagcaagactccatctcagaaaaaaaaaaaaaaaagaatccaatagtgtgatagtggacaaaagaatccaatagtgtgatagtggacatgaaaatacttcatggactacaaagctcttcaccctgctatctgcttcatctttgtggggcaggctgggtgcatcaccagactcctagtcaagtgctctctcttattgttcatggccttgtgttgccccagtcctgggggaggggctgacttttctgcaggactataggaaaggagaatcatagacatatgtccacttgtcagttacctgtgtttccttcttgtgctctgggcagccgatgcactttcctgattgctgtggagcctactaggatctaggaatgaatattgtgcctggctttgggggttcaaaactctccctcttggctcttgagctgcttacttgagcccattcccactctgtggagtgtacttttgcttcaataactctgtgctttctttttgtttgtttgttttttgagatggagtctcgctctgttgcccaggctggagtgcagtggcgcgatctcggctcactgcaagctccacctccagggttcatgccattctcctgcctcagcctcccgagtagttgggactacaggcgctcaccaccatgcccggctaattttttgtattttagtagagacggggtttcaccgtgttagccaggatggtcttgatctcctgacctcgtgatccacctgcctcagcctcccaaagtgctagaattacagacgtgagccactgcatccggcaaatctgtgctttcattgatttactctttcattgctttgtatgttttgtctgagtctttgttcaaactgccaagaacctggacaccctccactggtaacatattttggcgttccagccaggggacaataacgggaaagactccatctatgctacctgatcccccgcttggctgcatcctcaaccactggtatcaatttgaccccaataatctaaggaggaaatgcttgatattcttttgcaatagtttgtccccaatattgcttggaatctggagtttgttgttgaatgggaaagtgggatggtgttgtatgtatccaagcttttgtgctgctgttctaagcagggtcaggcctggttagcatgtggtgctctcttttggtgctgtttggccccggtgttctttggaatttaaaaatcaaactggcatggaaactgctttaccccaaaattttggttcacagccttcactggattacctactggggcaaacagagtgtaaccatgtaaaaccggcgagcttgtattgctatctcatggctagagttccaaggtaaaagccatttggatcttcatttgtgtgcgtgtatacatgtctaaatgtgtttatttgtatgtagacttactgttatatgttgtgcctaccacattggcttataagtaagagagtgcccataacttaataagtccaagcaattttcaagttcacgtgacttaagtaaatctttacgaaactagctagctttaaaattattggtaaatacaaatagaaatgtcttcagaattggcaacatacatttttatctgggttttatgtttttgtctttgctagatattttgaggtgtcaaggctatcaggctgggcgtggtggctcacatttgtaatgccagcactttgggaggccgaggtgggcggatcacctgaggtcaggagttggagaccagcctggtcaacatggtgaagccccgtttctactaaaaatacaaaaattagccaggtgtggtggcatgtgcctgtaatcccagctacttgggaggctgagggaggaggatcacttgaaccagggaggtggaagttgcagcaagccaagatagtaccactgcactccagcctgggtgacagagggagactcactgtctaaaaaaaaaaaagttataaagctattaacccagccaaaacaacaaaaacaaaaaactgtcccttttgcctttggttcactcttggatccagatggaaatctccagctgttctggtgttctggaccaagaagtttgagaaaataagaatccatggacaagaaaattttgaggtagtggttcagagttctggctcgtggcctcagttccaatcctggttctatccttgcttggtgtgaggccttaggaaatctccttgtgtcagtctgggtcctccgagaagcagagcttgctttgagactcaacatgcaaggattttttttttttgagacggagtctcactctgtcgcccaggctggagtgcagtggcacgatctcagctcactgcaagctccacctcccgggttcacgccattctcctgcctcagcctcctgagtagctgggactacaggcgcctgccaccatgcccggctaatttttttgtatttttagtagagacggggtttcaccgtgttagccaggatggtctcgatctcctgacctcatgattcacccgccttggcctcccaaagtgctgggattacaggcgtgagccaccgcacctggcctaacatgcaagggttttgttaggggaaacccttgtgtgaaaggagttagacagtgatgaagcctgactccaagggaggagaagagagaatgttggtggaactgtccgtgctgtgcggtctaaagaaaattggggtttccaaagtcagttgtcaagggcccctgtgttttctaggaatgagctgccttagtttctgtgctgccatacactattgatgggtgagatggattttaaatctagctgggcccttgctctcttatgctccccatagctggaggtcagtggcaggtgcattcttgtggccacgcatcacttaacctctcatgggattgttactacaatcaaatgagacaaggtgtgtaaaacacttggtacaagatctggcataaatactcaacatattttaactattatgattacccagttattctttcgaagccaacaagaaagttttcttctccttttgttatcaaccattccctgcatcagaggctgctaattcagtcagattccctgtaaatgagtgatgtgggccaagtgtaagacattagagagtgggagggactatggtaaactagaaagcacatgaaacatctaaaatggtttgaaaaatagctgggcgtggtggctcatgcctgtaatcctagcactccgtctcaaaaaaaaaaaaaaaaaaaaaaacccaacccaaaaccaccccaaaaaccccagtgaggttgattttcccacccccccaaacccattaataaatttgttgtgtatttgacgacatggagagacctggctggttgatttctggttttgtgcacagcttcagtgttgtcttttctgagaggttttgaatgtggacatcgggattggatggcatgggttgggatcttggctctcccacttgccagccatgagatattgggcaaattatgaaatctcgggcaaattatgaaatttcctggtaactcagtttttccatctgtaaaatggggataataatgattctcccctcatgaaatttcaatgaggatttaatatacagaaggagtttaggacagtgtctggaacatagtaaggctgagtaagtgttgatgttattctggggttgagagaaggagcaagaacaaccttgggttgctggaggctctcatggtttttcctcatcatttcattccacttaagcctaaaacaatatgatcggtataacacccagacaggaatgagtttctcttataccggtgatataatcatatataataatgccacttacataagcttccttagctccttgttaaggccacccacactccgttccacttcacactgttaaggaatgtttctcccacagggaaaaagacacccagctctatgctaattaccactttaaagcagggaccaaggggtgtgagggggggaaaccagcaaaggtgtctttggcagtgctcttgatttgggagagtaaagtctttagtttggaagcagtgagtcaggcctggggacctcagaggagccagaggcaacccatggtgtcccccagattaggcaggcccaacctacgccttaggtgaaaagtgtctgtgagccagccctctgcagacaaatgctaatctgccatttcttttattgcttaaaaaaagagagtctgagacatattctacgtgtgatacaagctcattgtggaaaatatggaaaatagatgggaacaaaatgaaagtgtaaaagtcagaagtcatgagcgatgaatatagtcaagctaacagaaaaaatataaaaagtcagaactcattcagctgaaagtgtcagaaatcaattgcaaactggtttagatgattcaagagaatatattggcccacagaacaaggctgtcacagaggtggatcaggcatggctgtatccagggctcaaacgttattagcggaatgccatcttgcttgctctgtctctatttcatgaataggccttctccagatggtggaaaaggtagacattatcaattccagattaatctccaccaactgaacaatgctactagaaaggaagaggctcttcccagtgctcagataggaaagtctcagggagggacttgattggctgaagatgtaccacgtgtgcatccttgaaccagtccctgtggttggggatgtaccacctgtgcatccttgaaccaatccctgtggttggggatgaggtgctctgattggccagatcagtgagtcaatggccaggggagatgaaatcaaggaatggtccacttaaataggtcctccacagggagtggtgattctgttccaaaagaaagagaaggaaatgaattgatgaaaacaatggatattgctatataagaagcatataacatctgtaatcccagcactttgggaggctgaggtgggcggatcacctgaggtcgggagttcgagaccagcctgaccaacatggagaaaccctgtctctactaaatataaatatatatatatttagctgggtgtggtggcacgtcccagctactcgggagactgaggcaggagaattgcttgaacctgggaggcagaggttgctgtgagccaagatgacaccattgcactccagcctgggtaacaagaacaaaacttcatctcaaaaaaaaaaaaaaaaaaaaaaaagaggtcaggtgcagtggtcacgcctgtaatcccagcactttgggaggctgaggtggtcggatcacgaggtcaggagatcgagaccatcctggctaacatggtgaaaccctgtctctactaaaaatacaaaaaaattagctgggtgtggtagcgggcgcctgtagtcccagctactcgggaggctgaggcaggagaatggcgtgaacccgggaggcggagcttgcagtgagccgagatcgcgccactgcactccagcctgggcgacagagcaagactctgcctcaaaaaacaaaacaaaacaaaaaaaagagaagcaaatgacaagtttccaatacttgcaccatctagaaataatgactgttgacttcttaatgtaaatcctcccagaattcacttccccttatttagctatacttataagcatatactagatacatagaacattgagatatcctatgcaaacttttgtaagctgattttgattgccttgtttaaaaatatcatttagatattttgaaatataagtggcatatcttctgggtagaaaaattagagaatatggacaaacaaaaataaaataactttttttaaataatttttttttttgaaacagagtcactctatcacccaggctggagtacagtagcatgatcttggctcactgcacctccacctcctgggttcaagcgattttcatgcctcagtctcctgagtagctgggattacaagtgcatgcaaccacgcccagctaatttctgtatttttagtagagacggggtttctccatgttgtccaggctgggattgaactcctggtctcaagcaatctgcctgcctcggcctcccaaagtgctgggattacaggtgtgagccaccacacctgatctaaaataacttataattggctggggttaatagtaagacttttaagaagccagattaagggcagggttgagatagaggaagaataatttgtcagagctcctcttatgataccctgtagtccctctttgcagtgctttgcacatttgtaattttacattaattactcaaagtggcttatttaaaataattttattctctaagtgttgctttccttaaaagaaataagaaaaaaaacccagaaaaaaagtgacctaaaataattttattctgaactatttcaggcacacaaaaaactataaagaccagtacagtgaacaaccatttacccgtcactcagtttaaaaaatataacaaagacaatcaagtccttctgtggacccctcttaatctcgtgctcctttctctcttccttccttcccaatgggatctctatcctgcagttgtgtcttatatttcatgcctattttgtattcttattgaatatatgttatccattatcaacatataacattatgttgcatatttaaacactttaagtagactaccactgtatgtattgttctcatggcttgctttttggttcattgttatgattttgcaatttatttttatttttatttatttatttatttttgagacagagtttcattcactcttgttgcccaggctggagtgcaatggtgtgatttcagctcactgcaacctccgcctcccaggttcaagtgattctcctgcctcaacctcctgagtagctgggattacaggcaggcgccaccatgcccagctaattttgtatttttggtagagatggggtttctccacgttggttaggctggtctcgaactcccgacctcaggtgacccgcccgccttggcctcccaaagtgctgggattacaggcgtgagccactgggcctggccgattttgcaaagtgttaatgttgatacaggttatgtttcatttattttctactattgttagtgttaatctgttagtactagcatccatggtagaactcaatcataattaatctatctattctgcagatggacatttaggttccttttttttttttttttttcttgagacagagtctcgctcttttgcccggctggagtgcaatggcgccatctcggctcactgcaaactccacctcctgggttcaggtgattctcgtgcctcagcctcctgagtagctgtgactacagcacccaccaccacacttggctaatttttgtatatttagtagagatggggttttgccatgctggccagggtggtcttgaacttctgacctctggtgatccgcccaccttggcctcccaaagtgctgggattacagtcgtgagccactgagcctggccgtctcccttcccttcctttcccttcccttcccttcccttcccttcccttcccttcccttcccttcccttccctcccctcccctcccctcccctcccctcccctccatctccctctcctccccttccttctttccttccttccttccttcctctttctctttctttttctctctttctttctctccctctttttctttttttcttctttcttttttttggagacagggtcttactttgtcacccaggctgaagtgcagtggtatgatcatggctcactgcagcctcgaccccccaggctcaagcgatcttcccacgccagccttcctgagtagctgggattataacaggcttgcaccgctatgcctggctaatatttgtattttttgtagagatggggtttcaccatattgtccaggctgggcttcaactcctgagctcaagcaatccacccaccttggcctcccaaactgctgggattataggcctgagccaccgcacctgacctgtttctatttttctattacaaacagtgctgtagtaaatattcctgtacaggccaggcacggtggctcatacctgtaatcccagcactttgggaggccgaggtgggcagatcacctgaggttgggagtttgagacagcctaatcaacatggagaaaccccatctctactaaaaatacaaaattagccaggtgtggtggcgcatgcctgtaatcccagctacttgggagactgaggcaggagaatctcttgaacctgggaggtggaggttgcgataagctaagatcacaccactgcactccagcctgggcaacaagagcaaaacgccatctcagatatatatatattcctgtacatttctccttgtgcaaactgatagagcttctcctggtctagggtatgtacctaggagtggaattgctgggctgtgggggttatacttcttcaactttactcaatttcaccaagttgctctgcacaacagttgtaccaatttacactcttacctgcagtacatgagaattccagtttctccgacatttggttttgtcagactttttatctttgccagtttgatgtgtgtgaaatgcagtctgctggcacccagtgttcaatcctgaagagctggatgcataggtcttgttcaccatggttcccccagcactttgcgcagcacctgaaatatagtaggtattccatattttttggctgactaattgagcagcagttttctggctcctctcatgtaaaattccattacaatttgttggagaagccatttgttctgcagggagtcctgttttcatctcactcttcccaattcaaaaccaggaaaccgggccaggcgcagtggctcactcctgtaatctcagcactttgggaggccaaggcaggtggatcacgaggtcaggagttcaagaccagcctggccaatatggtgaaaacccatctctactaaaaatacaaaaattagccgggtgtggtggcatgcgcctgtagtcccagctacttgggaggcagagacaggagaatcacttgaacctgggaggcagaggttgctgtgagctgagatcgccccactacattccagcctgggtgacagagcaagactccagctcaaatcaaccaaccaaccaggaaaccactcagggactaagcagagaaaacagcttttgattgccctgtttgcctttttgttagaactgcagttctcaaaactttcccatacctcagaaccacgtggagggcgtgttaaaatgcaaatcgctgggatccatccccccagaatttcttgttcaggaggtcgagggtaaggtctagggatctgcttttttttttttttttttttttttttttttttttgagacagggtcttgctctgtcacccaggctggagtgcagtggtgcaatctcggctcactgcatcctcgacctcttgggctcaagccatcctccccactcagcctccctagtagctgggactacaggcatgtgccaccacgcctagctaatttttgtattttttgtagagatgagtctctctatgttgcccaggctggtctcaaactcctgggctcaagcaatccacctgccttggcctctcaaagtgttgggattacaggcatgagccaccatgtccaaaataagatttgcgtgtgtaataagtacctgggtgattctgatgctggtgctgctggtctgggaactacactttgagaaccaccggatctgaggaacattcaatccagacattttggatatgatcaatgtggagtgtccttaaagagactgaatgcaaaacttgaaaagccactcccaaagtgtagagtggagggaagaatataacatctaactccacttagccggagtaggaaaaggagaagtctggaatgtttaagacagttggcagcatttatagagactgatataattcagtaagaatatattgggcaccaactgggttgtttccttccttcttctcttctcttctcttctcttctcttctcttctcttctcttctcttctcttctcttctcttctcttctcttctcttctctctctctttctttctctctctttctcccttcccttccctgcccttccctcccctcccctccccttcctttcctttccttccttcctttccttctctcctcccctcccctcccctccccttcccttccttttttttttgacagagtctctctcttgtcacccaggccggagtgcagtagtgcaatcttggctcattgcaacctctgcctcccgggttcaagcgattctcgtgcctcagcctcctgagtagctgagactacaggtgtgtgccaccacacccagttaattttaatttttattttttgtatttttagtatagatggggttttgttatgttggccaggctggtctcaaactcctggcctcaagcaatccacctgcctcggcctcccaaagtgctgggactacaggtgtgagccatcatgtccggccctgactgggttgtttccatctgctcgcaagtcttctacgtgctttcaagccaggatctttttttccattgatacttactcctgagatcaccgcaatcttctcttcttcctctacctcctccccttctcccccccccccctcctctcctcctcctcctccttcttcttctttttcctcttcttccatgaattaaattcagatgtggacttggctatgtgttgaaactataataaagatagctagcatttattgaggtcttggttgccaaatgcttttgttagtgttatctcacttcatcctccctcagacttcaggagataggtaccatagttacatccactttgtggatgaagtttagaggttacacagcaggtaaataacaaagctggggctgcaacccaggtcaccccaattccaatgtcttgttctttactgaaactatgtaccatacatctgtgattcttagcttccttattaattaattcaccaaatgttttctgagcacctcctaggtgctaggccctttgctgctgatatgggcaaatgagacagacaaaattcctggtagcacgacaatatgttttggccctgtgtccccacccgagtcttatctcaaattggaatccccataatccctaagtatggagggagggaccaagtggaggtcattgaatcatgggggcagtttccctcatgctgttctcgtgatactgattgagtgctcatgaaatgtgatgatattatagggcagtttccctgctcctgctcattctctctggcctgccaccatgtaagatgtgcctacttccccttcccccatgattgtaagtttcctgaggcctccccagccatgcagaactgtgagtcaattaaacttctttcctttataaattacacagtcttgaggctttctttccttttttctattttgtgagacagagtcttgctctgttgcccagactggagtgcagcggcatggtctcagctcactgcagcctctgcctcccaggttcaagcaattctcctgcctcagcctcccgaatagctggtattacaggcatgtgccaccacacctgggtaatttttctgtatctttagtagagaggggtttttgctatgttggccagtctggtgtcgtactcctgtaatcccagcactttgggaggcttgaggaaagtggatcacttgagtatttctttatagcagtgtgagtcatctcctattactgtttttttttttttttttttcaaaaagatgggatcttgctgtcacccaggttggagtgcagtggcttgatcatagctcactgcagtcttgaccttccaggctcaagcattctcccacctcaacctcccaagtatctgggacaacaagtgtgtgcaatcatacccgcctaattatttgtttattttttgtagagatgaagtcttgctatgttgcccaggctgttgtagaactcctggactcaagcaattctctcacctcagcctcccaaagtgctgggattataggcatgagccactgcgctggccacaatctcctattactctcatctatagaaggaaatgagactatccctctttgagggttgctgtgaggtttagggaaatgtgctcttggtacccagtagatgctcaataagcattacgctaggtatatagtaggtgctcaataagtgttgtgcttggtatatagttagtaggtgctcaataagtgttggctcctgatttccttcactcccaggagctggtaactctctatttgtgtacgtgggggagaatgaagccaattccaagagactacgatgttctcctagaaaaaggcattgcaccatctttaacatttgtgcagcccaccctctattagctcatctgagcaaatgcttattttcctggtctctggggacaagacttaggctcttttcatttgcctcctcaccctctccccatctccctattctagccagtatcacagaatatgcaacatcttgacaaaccaaaggcactgggcaatgctttaggaaactgtgcaatttagagagatgaacaatgaagaaatatcagctctaggcagcttgtgtgatggaaaataggagaagataagataaatgtgcagcttagaagggagagttctcacaggtaatgagagaaaatcaggagccaacatctatttagaggtattttccttcaagcatctggagcttttgaagaacctggataggagaaatctacattttaggagtgtaggctattttgtaatttccatctttgaaggcttcaactccatctttgctgtctgtgtgctagttatttctttttcaggctcaattttaataatttccttttttttcttttctcccaggaagagggtttaactctgcaacataatcagtgcacagaaacctaaattggaaatctctttcactacagacaagacagttcagaagtgaaaagtcacagtaaaattgggcatttctttccatagacttaacagaagcaacacctggattccagcagctgtactggtgtaactggcacttgaacgtctccatccaagtgcccctttgtggcagatgaagagttcaggttttgttcctcatcagctttgtgaccttgggcaaagtccttgacctatcagagcctcaatttccctatctgtggaaagacgaccatgaaaaaatatgcactatggggtggttctggtggggagagttaaattagatataatttagaaattcttagcataatatttgtatcatatatatgtttatatatgttaatatgtaacacataatagtatataagaaagtcatctatatgaacttcacacagcatattatattatatatacacactacatggtgtatatgacatatactatctaatatatgatatggtttggctgtgtccccacccaaatcttatcttgaattgtaaatcccacaattcccacatgttgtgggaggaacctagtgggagataattgaatcatgggagtgggtctttcctgtgctgtttttgtgatagtgaataagtctcatgagatctgatggttatatacacgggaatttccctgtacaagctctcttctcttgtctgctgccatgtgagacatgcctttcatcttctgccatgcttgtgaggccttcccagccacagttccacgtggctggggagtaataaacctctttcttttgtaaattgcccagtctcaggtatgtctttatcagcagcatgaaaacagattaatacaatatgttatatatatattatatagtatgtatctaatatagtatagtatactaagtattaaatattttataataaatataatactatagcatataaacatgagtacaatgatatatgctctaacatatgtactatgtaacataatggcacatacacatattataccatgtttgtattttatagtgtacataacatatactatatatcatatagtattctatagtatatatgatatacataccatataacacaaactataatatatgtactatatacactatatataatatagtatactatgtaatatatgctatatatacaagcaactgtcctctaaactatatcttatattatatattatgtaatataccaatataatatagtagagatgaaagtttcttgtgaattgaaaagccatgattaataaaagatgttattattcatatagagatatagatgactgataaggtttgtggtatgaccctgagtctctttttttctatcatctgcttgattcactacctgactcttaatttttctttctttctttttttttttttttgagacggagtcttgctctgtcacccaggctggactgcagtggcgtgatcttggctcactgcaagttccgcctcctgggttcacgccattctccgtcctcagcctcctgagtagctggaactacaggcacctgccaccatgcccggctaattttttgtatttttagtagagacagagtttcaccatgttagccaggatggtcttcacctcctgaccttgtgatccacccgccttggcctcccaaagtgctgggatttgagatggagtctcactttgtcacccaggctggagtgcagtggcgtgatcttggcttgttgcaacctccactttccatattcaagcaattctcctgcctcagcctcccaagtagctgggattacaggcatgtgccaccatgctcggctaatttttgtatttttggtagagactggtgttcgccatgttggccaggctggtctcgaactcctgacctcaggtgatccacccacctcagcctcccaaagtactgggattacaagcgtgagttaccatgcctggccctgactcttaatattttattttactgttttttcctcaactacttcttgttgcctttgtcattcggttaacgggccatcctcctctcaggagggccaccaaagggctgggagtcaccactgacacattgaaactcttttcctccctcctgctctacactcaccctacatctaacactctggctgcctctactgatcctggctctaaagcatggcctggatacatccactcttttctgagccccatcaccccatgccagctccccccacctgtctagacaactacaatagtctcttaactactctccctgcttcctccttcacctctttataatccactcttcacgtagtagcctgcgtgatcttttttttttatttttattttttttgagacaggatctcactgtcatccaggctggagtgcagtggcacaatcgcggctcactgcagcctcaacatttctgggctcagatgactctttttttttttttgagacagagtcttgctctgtccccaggctggagtgcagtggaacgatctcagctcactgcaagctccgcctcctgggttcacgccattctcctgcctcagcctcctgagtagctgggactacaggcacccgccaccacgcccggctaattttttatttttagtagagacggggtttcaccatgttagccaggatggtctcgatctcctgacctcgtgattcacccgccttggcctcccaaagtgctgggattacaggcgtgagccactgcgcccagccttgggctcagatgattctcccacctcagcctcctgagtagctgggaccacaactaatttttgtattttttttttactttattattattattattattgtggagacagggttttgccatgttggtcaggctgatcttgaactcctgagctcaaacaatcctcttgccttggcctcccaaagtgctgggattacaggtatgtgccactgtgcccggccaatctttaaagggagtaaatcggatcatgttacctagctgaaaacccttcattggtttttccaacacatgtagcataaattccgaactccttactgtcaatttttcctgaaatgtacctttgcctggatcactcccctgctctgccttgcccactctgctcctgcactggtgacagttcagctttcaaacacaccacactcaatcccaccttgtggcctttgcacttgctgtttccttgcccgggaatgtctttcctccaagatatctgcatggccctcttgttcactccattcaggactctctgcaattgttgctttatctggggggacattcctgatcatcctaacaaaaataacacctcccatcacttgtgtcttcttaacgtatcttgccatacatacatacttagcatttaccatatactctctggatatatatatatatatatatatatatatatatatatatatatatatttagcatttttacattctctgaaaggccccagagcgcttagtgtatggcacaaataggtaaataatggtaataattattactattcattttgttattatagacagtgctgtgtgagttttaaatcctttcatgagaaaaggtttttttaaggctgggcaaggtggctcatgcctctaatccagcactttgggaggctgaggcaggtggatcacctgaggtcaggggtttgaaaccaacctggccaacatggtgaaactccatctctactaaaaatacaaaaattagccaggtgtggtggcgcgagcctgtagtcccagctactcgggaggctgaggtgggaggattgcttgaatccaggagtcaaaagtttcagtgagctgagatcacaccattgcactccagcctgggtgagagaacaagactttgccccgccgacccccgccagaaaaaaaagttttttttttttttgagacagagtctctctctgtcaccaaggctggagtgcaatggcatgatcttgtttcactgcaacctccgcctcctgggtttaagcaattcctctgtctcagcctcctgagtagctgggattacaggcatgtgccaccacacctggctaatttttgtatttttagtagagacggggtttcaccatgttggtcaggctggtctcaaactcctgacctcatgatctgttccccttggcctcccaaagtgctgggattacaggcgtgagccaccgagcctggccctgttttttttgtttgtttgttttttgttttttttgtttttgttttttgtagagctgtagttttgctatattgcctaggctggtctcaaactcctggcttcaagcaatcctcctccctcggcctctcaaagtcctgggattacaggattgagctgccatgcaagaccaagaaaccgttttgatagtcagaaattatatagctaccatttatggagcttaactatgtgccccgcaggtgctaagttgttttttttttttttcaactctgtctcatttaactctcactatcacagaatgccttgaagtttgtattactgcaggagaggaggtgaactcaggatcagctttattaatattgataataatagtagtgttattaaatgaatgaatgaaagcacaacatgagacctattctaaggtgattagaagactaagcactcagctctgggattgaatggtggaggggcaggcagtttggaaggggaggcatcccttgtgtactcccaggagtgtccttatccagggtcaaccttggaggcaccaagatttattttattagagaaggcagccattcctcaccccgcactacccacagatccaaggcctgaggaatctgagaaatggcccccctagtccataggctcaatctattttcactgggagagaagcagcccaggcatatggggtctgcacctttcactgcgtaggtgataaaccttgagccaaatcagaattatcggtcttgtgttctgtcgtatggggcctcccaacactgtgaagtgcactcacacccacgtgcccttttatttatgacttttattgagccttctatgaagtcgtaaattgaccaaccctccaactggttccggccctcatcaggaagctatcatcaaagtgaatcaccttctcactggccacttgttccctgaaggttcattgcaaaggctgagatgttttctgggacttcttatagaatctgtcagccctagcttagaactgccaagccaaggtttttttgtttctgtttctgtttttttttttttttttttttttgttgttgttaagaaagagaagtaaaatacaaagtggaaaggtaatgtgtttgtttggccagggcctctcatctctgtacagtattctggaaatgcctcaatttctggagctgtggattggacgaggttgacctactcttattctggcctagaaaaagtctgagtaattcttgcatcagggaggccaggcatgttggctcatatctgtaatccagcactctgggatgctgaggcgggtggatcacctgaggtcaggagctcaagaccagcctggccaacatggtgaaaccccatctctactaaaaatagaaaatattagctgcgtgtggtggcagaagcctgtaatcccagctacttgggagtctgaggcaggagaatcccttgaacctgggaggtagaggttgcagtgagccaagattgtgccactgcactccagcctgggtgaaagagcgagactccatctcaaaaaaaaaaatatgtgtatatatatatatatattcttgcactagggatttggggacaaggcagagaacaacatattcctaagggaatatgggaaccagcaacttaaataaaaacaagggttggatcttggacgtaggagggacttgggtggaaatgatttccctaaaagcacagggtgctagagagtccctaagaactcctcagacacctctcaagccctgtgctggggaaacaacctgcattatctcatctactcttcagcaggcctctgtttcatctccatttcgcagatggagaaattgaggctcacagaggttatgtcactgtataagttgctctagatcacatggatactaaatggtagagccaagttctgaacacagattcttctttaatttattaaaattcacccatttggatgtgcatgtcaataatttttagtaaatttatttcgtttcattttatttcatttatttatttatttgagatggagtctcattctgtggcccaggcttgactgcagtggtgcagtctcggctccctgcaacctctgcctcccaggttcaagcgattctcctgcttcagcctcctgagtagctgggactataggcacatgccaccttgcctggctaatgtttgtatttttagtagagatggggtttcaccatgttggccaggctggtcttgagctcctgacctcaggtgacccacccaccttggcctcccaaagtgctgggataacaggcatgagccacttattttattttattttattcttttgagatggagtttcacttttgttgcccaggctggagtgcaatggcatgatcttggctcactgcaacctccgcctcccgggttcaagtgattctcctgcctcagcctcctgagtagctggattacaggcatgcaccaccacgcctggctaatttttgtatttttagtagagacggggtttctccatgttggtcaggctggactcgaactccctacctcaggtgatccgccagcctcagcttctcaaagtgccaagattacaggcttgagccaccatgcctggcccacttattattttgtaaagagacagggtcttgctctgttggccaggctggaggacagtggcataaccgtagctcactgtagtcttgaactcctgggcttaagccatcctcctacctcagcgtcctgagtagttaagactacaggcatgggctaccatgcccagctaatatttttagtaaattttaaaagttgtgtaattatcatgacaatacagtcttagaacctttccatggtgtccagaatgacccctggtgctgatttgccgtcaatcctcattcccatctgtagcttcagttgacaactgtgcctgggcctgtgtgtctctataaatttacctattccggacatttcatataaatagaatcacacaatatgtagtcttttcatttgacttcttttgcttatggtgagataactatgttgttttgtatattaacagttcattcctggctgggcgtggcggttcacgcctgtaatctcagccctttgggaggctgaggtgagtggatcacttgaggtcaggagttcaagaccagcctggacaacatgggaaaaccctgtctctactaaaaattcaaaaagtagccaggtgtggggaacgcacctgtaatcccagctactcagggggctgaggcaggagaatcacttgaacccaggaggcagaggttacattaagccaagattatgccactgcactccagcctgggtgacagagtaagactctgcctcaataaaaacaacaacgacaacaacatagttcattcctttttattcctgaatattattccaatgtttgggtataccccattttatttattcattttaccagttgatgagcatttggattatttctatttcttggctgctataaagagttctgctatgcacattcatgtgtaggtttctgtatggtcggatgttttcatttcatctgggtagtttcctagaagtggaattgctgggttttatggtaagctcatgttaaactttgtaagaaactgcgaaacttttcaaagagcctttgtcattttacattgaactcaggtctttgtgactctgacgtccaagttcttaaccactgcattatgtgtatgtctcatgttactccatgccatgaataatcaattcattttgacaattattgcttgatgtttattctatgctggtcgtggtactaaatggtaggaatagagaaatgaaaggatatggcttgttttctgccttttatggtagattgggttattattattattattattgttattatttttgagacagagtctcactctgttgcccaggctggagtgcagtggtgcgatcatggctcactgcagcctcaacattctgggctcaagtgatcctcctatctcagcctcctgagtagctgggatcatggcatgtgccaccatgcctggctaacttacacttttttttttctttgtagagacaaggtctcactgtgttgcaaagactggtctcaaactgctgggctcaagcaatcttcctgcctcaggctaccaaagtgctggggttacaggcttgagccacctagcctggttagattggttagtgatcacaatttttctaccatatgacctttcagtgtaccagatggacagagcatatttccccacccatattaggctgttcttgcattgctataaagaaataccagaggccacgcatggtggctcacacctgtaatctcggcactttgggaggctgaggcaggcggatcacgaggtcaggagatcgagaccatcctggctaacagggtgaaaccctgtctctactaaaaatacaaaaaattagccaggcatggttgcaggcgcctgtagtcccagctacttgggaggctgaggcaggagaatggcgtgaacccgggaggcagagcttgcagtgaaccgagactgcgccactgcactctagcctgggtgacagagcaagactccatctcaaaaaaaaagaaatactagagactggataatttataaagaaaagaggtttaattggctcacagttgtgcaggctgtacaagcatggagctggcatctgcttggcttctggggaagccgcagggagcttttactcatggcagaagtgaagagggagcaggcacgtcacatggcaaaagcaggagcgagagagagagtgtgggttagattctacaccctttttttttttttttttttttttttttttgagacagagtctcgctccagcaccaggctggagtgcagtggtgcgatcttggctcactgcaacctccgctttctgggttcaagccattctcctgcctcagcctcccgagtagctgggattacaggtgcgcactgccacgccgagctaattttgtatttttagtagagacagggtttcaccatgttggtcaggctggtctcgatctcctgaccttgtgatctgcccgcctcggcctcccaaagtgctgggattacaggcgtgagccaccgtgcgtagcccacacacttttaaatgaccagatctcatgaaaactcactcactatcgtgaagacagcaccaaatcatgagggatctgtccccgtgacccaaactaactccaccaggctccaccttcagcactggggattgcaattcaacatgagatttggctggggacaaatatccaaactatagcaccaccccatggtgttgggtttgcccatgtgacttgtggccaaggaacatgaatcagatatgatgcaaacagatgcctcacatgtgctttttgtgctgtagttcatgttcttgtgttctcctgatccattatgagaagaacacactctgcatagcggtttcttctttagtctgagagtcacagcaaaaatatgtgaggcagacctgaatttaacacacagcctaaagctaagtgcaggtttcccacagcatgaagtagacctgcccatctgatccctgcctagatcagttaaattgtagtcatcctactgatcactgagagttttcagaagtgtttgtcattgtaaacaactgaaatattagttgtttgttatgcggcaatagctgactaatgcatctttaaagagcctatataaagagatacacagaaatataaagcaatctataatagagagtacagtgaatgtctggagagagacacaaaatgagtactgtgggaaaccactctggtggtaagggtaaaattcagcttcatgaaaaaggtggtcttaaaggataaggaggattttgacaggtggaaatgagtgcagtgggatgtcatctaagcaaagaaaacagcataagcgaaggcctgaaagttttatacctccaggttttatgcctatctatggctcatgtcctgtgatctaagtttctcagaagacagagatgcatccactttcagggtgaggacctttagcttgtcacttctggtcatccctccagaatgagccgtttgcaatctttatgttagatctaaaatccacaggagcttagtgacagacattgatggctgttgctactgtctagatctggtcatggacgtgttccaccacccacagactcaccaccaccaccaccatatcgaatttaaaaatgagtctcttaaatacttaactgacttatcttgccaactcccattaaccagttttatgcctacttctctggagtgacaaccagataatgattatagggaaatttgtttttacttttcttttgcgtctgctgctttctttttgttagaatttttgtgatatacatttttgttttcaatgtttctatgttgtcttgttttatttgttgtttattgtattgcatagtcttgtctacagtatttaactggattttttttaaaagaagcactccaaactgaaaggcattgtcttttattagagaaatttaacccatttatgtttattgtgcctattgataagtttgaatttactcctgatatttcaaattccaatttaccatgttttaaaaattgatgcataataattatatattattatgcatcaattatgcaaaatatcacatgtatgaggtacatgtgatattttgatacgtacatacaatgtgtacttttcaaatcagggcaattaggatattcatcacctcagacatttatcatttctttgtgttgggagcatttcaaatattctcttctggctatttgggtatgtacaataaattattgttaactatagtcaccctactgtgctgttgaactctagaacttttccttctaactgtatttttgtacccgttaaccaacctctcttcacccctcactcacccccccaccctctggtaaccatacttctactctacttttatgagatgaactttttaaggtcctacatattagtgagaacatgcaatatttatctttttatgcctggcttatttcccttaacgtcctccagtttcattggtgttactgcaaatgacagaatttcattcctttttatggctaactggatattccattgtgtatatatattatattttgttttcttttcttttttttttttttgagacagagtttcactcttgctgcccaggctggagtgcaatggcacaatctcggcttactgcaacctccgcctcccgggttgaagtgattctcttgtcccagcctcctgagtagctgggattacaggcatgcgccatcatgcccagctaattttgtatttttagtacagacggggtttctccatgttgttcaggctgatctcgaactcctgacctcaggtgatctgcacacttcggcctcccaaagtgctgggattacaggcatgagccaccacgcccggcatatactacattttctttcttcatccattgacgaacacttagtttgattccatatgctggctattatgattagtgctacaataaacatgggtgtgcaggtatcttttctacatattgatttcctttttttggatatatacccagcatggaattgctggattatatggtagatctatttttagttttctgagaaatctctgtactgttttccataatggctgtactaattgtcattcccaccagcaatgcactagtgttgccctttctccacattctcaccagcatgttattttttgtctcattgatactagccattttaactggggtgaaatatctcgtaatggttttgctttgcatttcccttgtgattagtgacattgaatatttttttcatatccctgttgtccatttgtatgttttcttttgagaaatgttcatttaccctgttttaaagtttgttctttttctttcctgcttttttttccccctgttacattggttatgttttccttgatgcattttttttcttcagtggtttggaagaaatgcacgctagttctgtctctttggcaattatctttgacattttaaacacattatgaaacatactattctttcaaagtatagagttaattaggatttcatccggagcaaaagaacaagcagcatgttttcacttctctaccttagccatctgctgctatttcctacgttgaaatgatctggaactttagtttcagaatgttatttatgtacttatttatttttattgtggattcagggggtacatgtgcaggtttattatgtgggcatattacataatgctggagttttagcttctattgaacccatcacccaaacaatgaatatagtacacaacaggtaatttcaaccctttcccaccttccctactcccctcgcagaatattactgaaaacaattttagattttgtctgtttttccaaagtatactctttctggccaggtgcggtgactcacgtctgtaatcccagcactttgggaggctgaggctggcagatcacccgaggtcaggagtttgagatcagcctggccaacatggcaaaaccccgtctctactaaaaatacaaaaaatagccgggcatggtggtgcacgcctgtactcccagctcttcgggaggctgaggcaggaaaatcgcttgaacctgggaggcggatgctgcagtgagctgagatcacaccactgcactccagcctggatgacagggcgatactccatctcaaaaccaaaaccaaaaccacaaccacaacaacaacaacaacaacgtacgctctttcagaaagtctccgagttgaaaacgcctgtgtggccttctagcatccagtgttaccaacgaggaatatgctaccgatctgctacttcatcccttagtgaggtttttttttttttttctcttaggaactttttaggatactctgttctcactgaaattgcaccctgttgcaactaggtgtggttcttttccatgtcagattggtcttatttatagaatacatgatctgctcttagctctttgaagctatcagttatacttacattaaaatcttttgtttgtttgtcctattgtagtgattaagcatgtgagttctagaatcacaatactgggcttgaatcccagccgtgatcctttctggatatttgagggaaatttctgtagttacagcaggaacagaggtggggtgattccagattccagtattctaggcagaggcggcacttagcagaactagccctggtggaggtggccctctgataaattcagagctgatttatcagcagtgtcttcaatggcacaatgttagatggaggctgatgggttccagcctaggagcattagcagcttctaaaaatttattatttttatttttttaaacaaattattattattatttttatagaaatggggttgccccatgttgcccaggctggtcttgaactcctgggcttaagcgatcctgcctcggccccccaaagtgctgggattataggcatgagccacagcacccagcccattagcagtttttgatctacggttatcacgtcttctttttgctcctcagacccacccacttttccaattgctcttccatccatctccaaaccttatacctaactccttggtttgaaatatctagagtggtttctgctttgctgataccactggtttctgaaacatgagcataggacataattgatattggggtgaatgggaggaacagaatgatgcaaaattgtctgcttctgtgtatgagaaagacactggccaatcttaattctgcaagcccaggagggctcttaaattatatttattattattattatttttgagacagagtttcactcttgttgaccaggctggagtgcaatggcacaattttggttcactgcaaactccacctcccaggttcaagtgattctcctgcctcaacctcctgagtagctgggattacaggcatgtgccaccacgtccggctaattttgtatttttagtagaaacagggtttcgccatgttggccaggctggtttcgaacccctgacctcaggtgatccacccacctcggcctcccaaagtgctgggattacaggcatgagccactgtgcctggcctgttattattagtagtagtagcataatgcattgaacatagcttgtcaatgcttgggtgtcaggtaatcaacaccaagacgtcccttgagacttttgctttctaatttgccctgaggataggccaaaataagctagtgacatattgagttaattgggcatcaacccaggaattctgcttcttgctgtcctaccctggacttccccatgaagttagtggccccaggaggaaggtgagaaaagggtgaagctgcattacacttgcagtcagtgttcaagtcaccacaaaacggtgacctacctacacagtgccctgaatcctccagtcttgccccagatgacagaatccacatggacccttttactgaagcccgtcaggctccgcggttttatagatgatgtcaggaggagtgattaggaccaaaggaaaaaggttcctaggcacagttgctaaaactgtgctcctgaggtctgtaggagcccccaaggtctctgttgattactttaagcaaagctcttcagtttctctgtggggaacttctccctaagtgaccacaatcaggttagcaggtggctgagtaaacaaggctgaacaatgggttttccgtcaagttggtttatatcagcaagaagccctaaatctgttttttttttttttttccagtccctcctggagatgaagaaagagttcagtcaccctgctgaggagagaaaaggccattattgtcaaaagaaggcacctgtcctagatttaagggaggtgcgttatcctggatggtttctaggcctcagtgggatggtctgatgacttcgtctcaccccccaggtacctaggaaggtgatgaatgtgaaggtggattcttcatggagctccacactcaggatctggtatctgaagcttcctgcattatgtcagcttatctactttgtccagctccccattagagaaatcctgctttcttaccagcataggtcactgcgctactaagaacatttcttttccttttttttcccctccagagatgtggtcttgccctgttgtccaggccggagcacagtggtgcaatcctacctcactgcaccctctaactcctggactcaagtaatcctcctacctcaacctgcacgtagctgagactccaggcgtgagccatcgtgcctggctattttttgtattttaattttctgtagagatggggtctcgtcatattgcccagattggtcttgaactcctggcctcaagtgatcctcccacctcatcctcccaaccccgtttcttttcagtcagacaaccagcctggtctttattacactggttcagagtcagctggaaaagaattctcttttcctgggccaggcaatcagtgttcaagtcccagtgggatctcattcgagtcatgtgactttgggccggttcttcacctctgagaacctcagtttctccacctgtaaaatggatgtggcactagagcctgtaccacttgccttgtagggatgtggcaagtctcaaaggtggtgatataaggggagcgttgggtaaactgtaactctcagctatctgaatgtgcgcctgttctctctcacgttaggaaccgtagcaaggcactagaagaggttatattttatatatatattattttttatattattatatattaatgttatacaaaatacattataaatgtaaattatattattatatattaatgtaatacaaatattacattttatctacaaatcatttggctgagccttggatgtcaattgggctgtttaatgccctgacgaagatctcttatacatccatatgagaaagggtttctatactggaagatactgcctctctttttacatgcaaggaccttgctaaagtgcagtttctgattcactgggtctgatgcaggactggagattgattctgcattttcctcaaactcccaggtcatacccatgctgcaggtatcacatttagtagcaagaatgtaggaaacatggtcttttctggtggctctcttgatgttttgctacacttgtatttacttgtctcaactagactccacctcctgcagtctcacatgacccatgcaactcaacggaagtcatacaacaatcactagcagtaagtacccgcagctgtagaaacaaacaaacaaatgaaaaaacccaaacaataacatttgcacaaggacccaaacttggcagtgcacctagaagagtttgtagcgtaccattggttataaacattgtacaacacaaacctaaactattacatttgtgaggggataggttgccatttcccttgcttgtttatgagcaaaaacttgagagctgcattatttttgccttcccagatagcactgaccctcagtaaatgtttgatgagctaaaagtgcctttagtgagtgggaaattaagcaaggcccttgattgtacatctattgctccaaacttcagaaaaaccaatcataacttttacagaacatctcctccctatgctgctttatttctttccatacatagctgaactcatcacctgagactcaacttccacccatcttgtcctataagttcagatttataagggcagggcaggcaaagaagcccttagactttgcttgttggtctctcctgtaaccctgaaataaccacgtttaccacgtttattcccaaagctcatattgagttcaaatcccctgttactcatttagagagacaagtggcattcatcatttttgcctctctgtgtcttcctctcccccagaacaatggcattacatgacgattaactccttttgatataaacaagtccaatggcagagtgttggatgactcagaaaacccaggcattgaaagatgcaaaatattttattgtgttcttgcattatgaagcattggggagtgttaagcatttttctttgatttttctctccctccctccctccctccctttctcctgccctcctcccctttctcctttccttcatcctttccttccttcctttccctccctttctcctgccctcctcccctttctcctttccttcatccttcccttcccttgcctcccctcctcttccctcccttcccttcccctcctttcctttccccttcccttcccttcccttcccttcccttcccttcccttcccttcccttctcttccctctcttccatcttttcatctatatctgccattttgcctaacacccatgtgctggagaagaaagaaaacaaggacttaaagagggaaaaaattcaaagaaagaaaaatgaaaggtagacagagcttatgcattttgaaggtgtgaaaattaggatttcagcctttttttttttctccccactaaaccagcaagcaggcaaataaagaaaccctgcagggattgacacaagatgagcaaagttttagaagattttcctcagaaaaaaaaccctcgcagatttacaagcagcatatctgttgtgaggatttcgaaggagatgaaaatatattgctagctatctagacatttgtcaaaacaactgaattctatgaattggaaaggatgaacgaaacaaccaatcctggggaaagaaattcaagatgggctctgttgtgttagaatttttctacaaagacagggaagttttagctgtgtgagataaagccttgcaccaaatgagaagccaacagaccttggaaaggggcgttcagtttcaccttgaagggcacttggctttgtcaattctggatatgtggtcaaacccccttatcctcatacctgtctcactccatccctaaatcagggacctgtctgatttagaaaaatagtgcctcccttttggatatggggagagggtcaggataccttaatttacagttcgccatgtctcttcacagaagggagaggtaattctccaaaaggaaaaaaggggtgctgttaccagaagaatgattcgatgctgggcaactaaaaccaacaaatgtcttctccacttggagaataagacttaatttcaatattgaatcctgttgatgtcacagttgcctggacctgacttcccaggccctgtttgttatgagtgcatttgtttccttggtgcatggcataccagtaggaatgggcacacctaatgctcagatcttggctctttttttgtttttttgaggtggagtttcactctgttgccaggctggagtgcagtggtgtgatctcggctcactgcaacctctgccttctggtttcaagtgattctcttgcctcagcctcccaaatagctgggactacaggtgcccaccaccatgcccagctaatttttgtatttttagtagagacggggtttcgccatgttggccaggatgatcttgatctcttgacctcgtgatctgcctgccttggcctcccaaagtgctggggttacaggtgtgacaaatcttggttcttaaataccattgtgcattaaaagttagccattggagaaatggctgattccagggctggggcaggaaaactacaaggtacacctaaatttttttttctcatcagaatgtatggagtggtaagaaaaaatgacaggggcatgtcgcaatgatataggagccagcttgaagggagtccaacttcaaaatcagggtcaaaatattcagattgggctttccaaatctgggataatctaagcatggaaattaataatgacagaaatggaaaacaacacatggaatccctgaatttatactgatattaaaaaaaagacaagggagagagaagggaatgagcttatttactgaagaatgtcaactaataaatgtagaaggaattagacttagaaactcaaactcttgttgggtgcagtggcttatgcctgtaatcccagtgctttgggaggctgaggcaggaggatcattggaggccaggagttcgagaccagcctgagcttgtctctacaaaaaatttaaaaaaaagaattagctgggcacgatggtgtgtacctatagtcccatgtccttgggggctgaggcaaaagaatctcttaagcccaggagtttgaggctgcagtgagctatgattatgccactgcaccccagcctgggtgacagagtaagatggaatatggaatattgctgggaagggtatggtaccagtcttgaaatatttccccacagataacttattatttcatagtaaggcaccttcagagtggagaaatatgtgggcaccatcttagctgagtaatcaagctgatcatcatatgcttcctcatacaatgcctgtacaatattcttgccaaaaatgtaaccacaaggagacaatccaataaactcaactggtgatacatgcaacaaaaaaagagaataatgggttaaagagtgatggatggagaccacactgaacaagacagggaactctctgaggatggtgactcctgagcagagaccagaatgatgggaaggagccaagtatgagaagatcttggtggaaggtgttctgggaagagggaatagcaagtgcaaaggccctggggcaggagtgaatgaggagtagaaagaccagtatggctagagcattgtggaagaaaaggagagtgatatgatgtgagattagagagcgaggtgagggcagatgttgtagggttttgaggccatatgaggaatttagttttgtttttggtgtatatagtagagattaatttttaaatggatacataatatttttacatatttatgggacacatgagatattttgttacatgtctcacatgtgtaatgaccaaatcagggtatttaggatatccattatcttgagcatttatcattcctttgttttgggaacatctcaaatcctctcttccagccattttgaagtatagaacacatcgttgttaactgcagtcaccctgccatgctgttgaactgcagtactgattttttccatctaactgtatgtctgtccccattaaccagcctctcttcattacccccacccacacactcttcccagccttcggtatctatcattctaccctctacctccatgagatcaacttttcagctcccagatatgagtaagaacatgtgatatttgtctttctgtgcctggcttatttcacttaacgtaatgacctccattttcacagtaggagttaaattttaacataccatactctgagtatgtatctgtgctgaataactatatttacccatttatatctacagctatatctagaaactacctcactaacactactcaattcagctgttggaagactttaaaatatttttggaacaacttgtgcgtatgaatttactctttcaatggtaaattttatgaaatctaactatatagtaagtatttccaatgaaaatttagcatctgtatggagatgtgttgcaaatgtaaaatgcacactagattttaagaaaagaatgtaactatctcaaaaataattttaaattcttgatactatgtcgaaataacgttttgaatacattgacttaaaatattataaattaatgctgtatgtatctttttgctttttaaaattacagctccattgagatattcacgtaacattgaaaatgtacaatttgatcatttttagtatattcaaagagttgtgtgattatctctgcaatcaattttagaacatttttatcatctcccaaaaaagccccatactcttctcagttctaattattctccaacccttccagccttaagcaaacactaatctttgtcttcttggatttgcctattctgaacacttcacagaaatggaatcatatactgtaatatttgtttttttacatttgtcttctctcacttagcataatgcgttcaaggttcatctctgttgtagcatatataggtactttattctttttgactgctgaataatgttctattatatgctacattttgttgatgaacatttggtttgttttctctttttggctctggggaataatcctgatgtaaacatgcatgtacaagttttagtgtggacatgtgttttgatttctcttgggtatatatctaggagtgggattgctgggtcctatagtttttgctatttaattaattaattaatttattaatttatttattttgagacgggtctcactctgtcgcccaggctggagtgcaatggcacaatctcaactcaatgcaacctccgcctcccgggtttaagtgattctcctgcctcagcctcccgagtagctgggattacaggtgtgcaccaccatgcctagctaatttttgtatttttagtagagacagggtttcaccatgttggccaggctgttctcgaacttctgacctcaagtgatccacctaccttggcctcccaaagtgctggaattacagacgagccactggccagcttttggttttttaaatgtggcaactagaaaatttgaaagtatatgtgtggcttgcattataattctattgcaaagtcccaatctaaccaaatcaaatttcctgagaggtccctgtcctgccaaggaacaaggaaaacagctaaacttgccaattagagatgtctcggtctcttaaagttttgagtggtcccattttaccctcccataaaacaatctttttttcaggtaaatattcagctggtttaaacattcaactctcttttggggctattccttccttttctgtcttgcttctacagatggtgcctaggttcaagggacagcttgggaggaagtctgtggttcacactttctccttggcatctttatttttattttattttatttattgattgattgagacaaggtctcgctgtgctgcccaggctggagtgcagtggcaaaacctcggctcatggcaacatccacctcccaggttcaagcaattctcgtgcctcaggctcctgagtagctgggactacaggtgtgcaccatcatgcctggctaattttagtatttttagtagagatagggtttcgctatgttggccaggctagtctcgaactcctgacctcaagtgatctacctgccttgacctcccagagtgctgggattacaggcatgaaccaccatgcccagccccctccttggcatctttaaaagtaaatcctgggcagtgtagcacttttgtcttgtttctgggtatctagcaggcttgcccatggagcagtggtagagggagcctccagaaggtgatgtctgtggcctctgcttaactcagcaggccccgctgccattcctcctcagctctgggtgcctgtctgttggtgcagggccccccagtgatttccccagctgagtctctgcctaaatgcctccctcagacctttccaaagtcacatggctccagcactatgccaagcatggagaattttcccggggaatcagaattttcttggaatatgcacctgggatgtgaggagcgaagtcttgcaatggtcattctccaacattatccagttatttctaccttccctggcttcctaccccaaagaaagaagagccaggaaatttcactagatttggcaagatgattgatgactttgattttaaaaataataagttatgtgctggtggttatctaggtctacacatctgtgcatacataataagtgtatgcttcaaatgggtgcattttattctgtataaattttatcccagcaaagttgatttaaagaaagagcaggttcaatttatatacattgtgctgggaagatatttatgatacagtgttaaaatatatttttgcatgaaagaagccagttgcagagcaatgagtagtaagataatacttttgtagttaaaacgtgaaaaaagaggaaaagctcctatatatattctgtgtttctcacgtaaacacaaagagattgtagaaaacaacacaaactgcttatctagaagaggactggctggagaataatggtgggcaggggaagggttaagtttgtctctgtatcttcctgtattgtttaactggtccttttttgtcgtgagacagtcttgctctgttacccaggctgcagtgcaccaccaccaccatgccaccatgccaccatgccaccacgccaccacgcccagctaatttttgtatttttagtagagaca
